(12) United States Patent
Blaschuk et al.

(10) Patent No.: US 6,638,911 B1
(45) Date of Patent: Oct. 28, 2003

(54) COMPOUNDS AND METHODS FOR MODULATING DESMOSOMAL CADHERIN-MEDIATED FUNCTIONS

(75) Inventors: Orest W. Blaschuk, Westmount (CA); James Matthew Symonds, Ottawa (CA); Barbara J. Gour, Kemptville (CA)

(73) Assignee: Adherex Technologies Inc., Ottawa (CA)

( * ) Notice: Subject to any disclaimer, the term of this patent is extended or adjusted under 35 U.S.C. 154(b) by 0 days.

(21) Appl. No.: 09/535,852

(22) Filed: Mar. 27, 2000

Related U.S. Application Data

(63) Continuation-in-part of application No. 09/187,859, filed on Nov. 6, 1998, now Pat. No. 6,358,920, which is a continuation-in-part of application No. 09/073,040, filed on May 5, 1998, now Pat. No. 6,472,367.

(51) Int. Cl.[7] .................. A61K 38/08; A61K 38/12; A61K 38/16

(52) U.S. Cl. .............. 514/15; 514/12; 514/13; 514/14; 530/324; 530/328; 530/387.1

(58) Field of Search .............. 514/12, 15, 13, 514/14; 530/324, 328, 387.1, 402

(56) References Cited

U.S. PATENT DOCUMENTS

| | | | |
|---|---|---|---|
| 5,585,351 A | 12/1996 | Ranscht | 514/12 |
| 5,597,725 A | 1/1997 | Suzuki | 435/328 |
| 5,610,281 A | 3/1997 | Brenner et al. | 530/388.85 |
| 5,639,634 A | 6/1997 | Suzuki | 435/69.1 |
| 5,643,781 A | 7/1997 | Suzuki | 435/325 |
| 5,646,250 A | 7/1997 | Suzuki | 530/350 |
| 5,663,300 A | 9/1997 | Suzuki | 530/350 |
| 5,708,143 A | 1/1998 | Suzuki | 530/350 |
| 5,811,514 A | 9/1998 | Bard et al. | 530/324 |
| 5,916,771 A | 6/1999 | Hori et al. | 435/69.6 |
| 6,031,072 A | 2/2000 | Blaschuk et al. | 530/317 |

FOREIGN PATENT DOCUMENTS

| | | |
|---|---|---|
| GB | 2 282 379 A | 4/1995 |
| WO | WO 91/04745 | 4/1991 |
| WO | WO 94/11401 | 5/1994 |
| WO | WO 96/27387 | 9/1996 |
| WO | WO 98/02452 | 1/1998 |
| WO | WO 98/25946 | 6/1998 |
| WO | WO 00/02917 | 1/2000 |

OTHER PUBLICATIONS

Albeda et al., "Adhesion molecules and inflammatory injury," *The FASEB Journal* 8(8):504–512, 1994.

Berndorff et al., "Liver–Intestine Cadherin: Molecular Cloning and Characterization of a Novel $Ca^{2+}$–dependent Cell Adhesion Molecule Expressed in Liver and Intestine," *The Journal of Cell Biology* 125(6): 1353–1369, 1994.

Blaschuk et al., "E–cadherin, estrogens and cancer: is there a connection?," *The Canadian Journal of Oncology* 4(4): 291–301, 1994.

(List continued on next page.)

Primary Examiner—Marianne P. Allen
(74) Attorney, Agent, or Firm—Seed IP Law Group PLLC

(57) ABSTRACT

Modulating agents for inhibiting or enhancing desmosomal cadherin mediated cell adhesion are provided. The modulating agents comprise one or more of: (a) a peptide sequence that is at least 50% identical to a desmosomal cadherin CAR sequence; (b) a non-peptide mimetic of a desmosomal cadherin CAR sequence; (c) a substance, such as an antibody or antigen-binding fragment thereof, that specifically binds a desmosomal cadherin CAR sequence; and/or (d) a polynucleotide encoding a polypeptide that comprises a desmosomal cadherin CAR sequence or analogue thereof. Methods for using such modulating agents for modulating desmosomal cadherin-mediated cell adhesion in a variety of contexts are also provided.

14 Claims, 13 Drawing Sheets

OTHER PUBLICATIONS

Bussemakers et al., "The role of OB–cadherin in human prostate cancer," *Proceedings of the American Association for Cancer Research Vol. 39,* No. 3405, New Orleans, LA, Mar. 28–Apr. 1, 1998.

Edgington, Stephen M., "How Sweet It Is: Selectin–Mediating Drugs," *Biotechnology* 10(4):383–389, 1992.

Fredette and Ranscht, "T–Cadherin Expression Delineates Specific Regions of the Developing Motor Axon–Hindlimb Projection Pathway," *The Journal of Neuroscience* 14(12): 7331–7346, 1994.

Getsios et al., "Regulated Expression of Cadherin–6 and Cadherin–11 in the Glandular Epithelial and Stromal Cells of the Human Endometrium," *Developmental Dynamics 211:* 238–247, 1998.

Grillner and Matsushima, "The Neural Network Underlying Locomotion in Lamprey—Synaptic and Cellular Mechanisms," *Neuron 7:* 1–15, 1991.

Inoue et al., "Cadherin–6 in the Developing Mouse Brain: Expression Along Restricted Connection Systems and Synaptic Localization Suggest a Potential Role in Neuronal Circuitry," *Developmental Dynamics 211:* 338–351, 1998.

Kahan, Barry D., "Immunosuppressive therapy," *Current Opinion in Immunology* 4(5):553–560, 1992.

Kawamura et al., "CdNA Cloning and Expression of a Novel Human Desmocollin," *The Journal Of Biological Chemistry 269(42):* 26295–26302, 1994.

King et al., "Cloning of the cDNA (DSC1) Coding for Human Type 1 Desmocollin and Its Assignment to Chromosome 18," *Genomics 18*: 185–194, 1993.

King et al., "The Desmocollins of Human Foreskin Epidermis: Identification and Chromosomal Assignment of a Third Gene and Expression Patterns of the Three Isoforms," *J Invest Dermatol 105:* 314–321, 1995.

Koch et al., "Complete amino acid sequence of the epidermal desmoglein precursor polypeptide and identification of a second type of desmoglein gene," *European Journal of Cell Biology 55:* 200–208, 1991.

Kogan et al., "A Single Amino Acid Residue Can Determine the Ligand Specificity of E–selectin," *The Journal of Biological Chemistry* 270(23):14047–14055, 1995.

Kohmura et al., "Diversity Revealed by a Novel Family of Cadherins Expressed in Neurons at a Synaptic Complex," *Neuron 20:* 1137–1151, 1998.

Lutz et al., "Antibody Recognition of Peptide Sequences from the Cell—Cell Adhesion Proteins: N– and E–cadherins," *Peptide Research* 9(5):233–239, 1996.

Matsuyoshi and Imamura, "Multiple Cadherins Are Expressed in Human Fibroblasts," *Biochemical And Biophysical Research Communications 235:* 355–358, 1997.

Munro et al., "Characterization of Cadherins Expressed by Murine Thymocytes," *Cellular Immunology 169:* 309–312, 1996.

Munro and Blaschuk, In: *Cell Adhesion and Invasion in Cancer Metastasis*, P. Brodt (ed.), RG Landes Co., Austin, Texas, 1996, Chapter 3, "The Structure, Function and Regulation of Cadherins," pp. 17–34.

Nakagawa and Takeichi, "Neural crest cell—cell adhesion controlled by sequential and subpopulation–specific expression of novel cadherins," *Development 121:* 1321–1332, 1995.

Navarro et al., "Differential Localization of VE– and N–Cadherins in Human Endothelial Cells: VE–Cadherin Competes with N–Cadherin for Junctional Localization," *The Journal of Cell Biology* 140(6): 1475–1484, 1998.

Ngo et al., "Computational Complexity, Protein Structure Prediction, and the Levinthal Paradox," *The Protein Folding Problem and Tertiary Structure Prediction,* K. Merz, Jr. and S. Le Grand (eds.), Birkhäuser, Boston, pp. 491–495, 1994.

Okazaki et al., "Molecular Cloning and Characterization of OB–cadherin, a New Member of Cadherin Family Expressed in Osteoblasts," *The Journal of Biological Chemistry* 269:(16): 12092–12098, 1994.

Parker et al., "Desmosomal Glycoproteins II and III. Cadherin–Like Junctional Molecules Generated By Alternative Splicing," *The Journal of Biological Chemistry* 266(16): 10438–10445, 1991.

Ranscht and Bronner–Fraser, "T–cadherin expression alternates with migrating neural crest cells in the trunk of the avian embryo," *Development 111:* 15–22, 1991.

Ranscht and Dours–Zimmermann, "T–Cadherin, a Novel Cadherin Cell Adhesion Molecule in the Nervous System Lacks the Conserved Cytoplasmic Region," *Neuron 7:* 391–402, 1991.

Redies and Takeichi, "Cadherins in the Developing Central Nervous System: An Adhesive Code for Segmental and Functional Subdivisions," *Developmental Biology 180:* 413–423, 1996.

Rozdzinski et al., Antiinflammatory Effects in Experimental Meningitis of Prokaryotic Peptides that Mimic Selectins, *J. Infect. Dis.* 168:1422–1428, 1993.

Sacristáan et al., "T–Cadherin 2: Molecular Characterization, Function in Cell Adhesion, and Coexpression With T–Cadherin and N–Cadherin," *Journal of Neuroscience Research 34:* 664–680, 1993.

Sano et al., "Protcadherins: a large family of cadherin–related molecules in central nervous system," *The EMBO Journal* 12(6): 2249–2256, 1993.

Shibata et al., "Identification of Human Cadherin–14, a Novel Neurally Specific Type II Cadherin, by Protein Interaction Cloning," *The Journal Of Biological Chemistry* 272(8): 5236–5240, 1997.

Shibata et al., "Simultaneous expression of cadherin–11 in signet–ring cell carcinoma and stromal cell of diffuse–type gastric cancer," *Cancer Letters 99:* 147–153, 1996.

Shimazui et al., "Complex Cadherin Expression in Renal Cell Carcinoma," *Cancer Research 56:* 3234–3237, 1996.

Shimoyama et al., "Isolation and Sequence Analysis of Human Cadherin–6 Complementary DNA for the Full Coding Sequence and Its Expression in Human Carcinoma Cells," *Cancer Research 55:* 2206–2211, 1995.

Shimoyama et al., "Molecular Cloning and Characterization of a Novel Human Classic Cadherin Homolgous with Mouse Muscle Cadherin," *The Journal of Biological Chemistry* 273(16): 10011–10018, 1998.

Simmonneau et al., "Cadherin 11 Expression Marks the Mesenchymal Phenotype: Towards New Functions for Cadherins?," *Cell Adhesion and Communication 3:* 115–130, 1995.

Slootstra et al., "Structural aspects of antibody–antigen interaction revealed through small random peptide libraries," *Molecular Diversity 1:*87–96, 1995.

Sugimoto et al., "Molecular Cloning and Characterization of a Newly Identified Member of the Cadherin Family, PB-cadherin," *The Journal Of Biological Chemistry* 271(19): 11548–11556, 1996.

Suzuki et al., "Diversity of the cadherin family: evidence for eight new cadherins in nervous tissue," *Cell Regulation 2:* 261–270, 1991.

Tanihara et al., "Cloning of Five Human Cadherins Clarifies Characteristics Features of Cadherin Extracellular Domain and Provides Further Evidence for Two Structurally Different Types of Cadherin," *Cell Adhesion and Communications 2:* 15–26, 1994.

Tkachuk et al., "Identificaiton of an atypical lipoprotein–binding protein from human aortic smooth muscle as T–cadherin," *FEBS Letters 421:* 208–212, 1998.

Vestal and Ranscht, "Glycosyl Phosphatidylinositol–anchored T–Cadherin Mediates Calcium–dependent, Homophilic Cell Adhesion," *The Journal of Cell Biology* 119(2): 451–461, 1992.

Ward and Mulligan, "Blocking of adhesion molecules in vivo as anti–inflammatory therapy," *Therapeutic Immunology 1:*165–171, 1994.

Wheeler et al., "Desmosomal glycoprotein DGI, a component of intercellular desmosome junctions, is related to the cadherin family of cell adhesion molecules," *Proc. Natl. Acad. Sci. USA 88:* 4796–4800, 1991.

| | | |
|---|---|---|
| Obcad | EC1 | RSKRGVWVWNQFFVIEEYTGPDPVLVGRLHSDIDSGD---GNIKYILSGEGAG----TIFVIDDKSGNI-HATKTLDREERAQ----YTLMAQAVDRDT--NRPLEPPSEFIVKVQDINDNPPEF |
| Obcad | EC2 | ----LHETYHANVPERS-NVGTSVIQVTASDADDPTYGNSAKLVYSILEGQP-----YFSVEAQTGIIRTALPNMDREAKEE----YHVVIQAKDMGG-HMGGLSGTTKVTITLTDVNDNPPKF |
| Cad5 | EC1 | RQKRDWIWNQMHIDEEKNTSLPHHVGKIKSSVSRKN----AKYILKGEYVG-----KVFRVDAETGDV-FAIERLDRENISE----YHLTAVIVDKDTG--ENLETPSSFTIKVHDVNDNWPVF |
| Cad6 | EC1 | RSKRSMMWNQFFLLEEYTGSDYQYVGKLHSDQDRGD---GSLKYILSGDGAG----DLFTINENTGDI-QAFKRLDREEKPV----YILRAQAINRRT--GRPVEPESEFIIKIHDTNDNEPIF |
| Cad6 | EC2 | ----TKEVYTATVPEMS-DVGTFVWQVTATDADDPTYGNSAKVVYSILGQP-----YFSVESETGIIKTALLNMDRENREQ----YQVVIQAKDMGG-QMGGLSGTTVNITLTDVNDNPPRF |
| Cad6 | EC4 | ----SKLAYILQIREDA-QINTTIGSVTAQDPDAAR--NPVKYSVDRHTDMD---RIFNIDSGNGSI-FTSKLLDRETLLW----HNITVIATEINN---PKQSSRVPLYTKVLDVNDNAPEF |
| Cad7 | EC1 | RTKRSWVVWNQFFVLEEYMGSDPLYVGKLHSDVDKGD---GSIKYILSGEGAS----SIFIIDENTGDI-HATKRLDREEQAY----YTLRAQAHDRLT--NKPVEPESEFVIKIQDINDNEPKF |
| Cad7 | EC2 | ----LDGPYTAGVPEMS-PVGTSVVQVTATDADDPTYGNSARVVYSILQGQP-----YFSVEPKTGIIKTALPNMDREAKDQ----YLLVIQAKDMVG-QNGGLSGTTSVTVTLTDVNDNPPRF |
| Cad7 | EC4 | ----TSRLYSMVVSEAA-KVGTIIGTVAAHDPDASN---SPVRYSIDRNTDLE----RYFNIDANSGVI-TTAKSLDRETNAV----HNITVLAMESQN---PAQIGRGYVAITLDINDNAPEF |
| Cad8 | EC1 | RSKRGMVVWNQMFVLEEFSGPEPILVGRLHTDLDPGS---KKIKYILSGDGAG----TIFQINDVTGDI-HAIKRLDREEKAE----YTLTAQAVDWET--SKPLEPPSEFIIKVQDINDNEPKF |
| Cad12 | EC1 | RVKRGMVVWNQFFVLEEYVGSEPQYVGKLHSDLDKGE---GTVKYTLSGDGAG----TVFTIDETTGDI-HAIRSLDREEKPF----YTLRAQAVDIET--RKPLEPESEFIIKVQDINDNEPKF |
| Cad12 | EC2 | ----LDGPYVATVPEMS-PVGAYLQVKATDADDPTYGNSARVVYSILQGQP-----YFSIDPKTGVIRTALPNMDREVKEQ----YQVLIQAKDMGG-QLGGLAGTTIVNITLTDVNDNPPRF |
| Cad14 | EC1 | RPKRGMVVWNQFFVLEEHMGPDPQYVGKLHSNSDKGD---GSVKYILTGEGAG----TIFIIDDTTGDI-HSTKSLDREQKTH----YVLHAQAIDRRT--NKPLEPESEFIIKVQDINDNAPKF |
| Cad14 | EC2 | ----TDGPYTVTVPEMS-DMGTSVLQVTATDADDPTYGNSARVVYSILQGQP-----YFSVDPKTGVIRTALHNMDREAREH----YSVVIQAKDMAG-QVGGLSGTTVNITLTDVNDNPPRF |
| Cad14 | EC4 | ----SMPSYLMEVYENA-KIGTVVGTVLAQPDSTN----SLVRYFINYNVEDD---RFNIDANTGTIRT-TKVLDREETPW----YNITVTASEIDN---PDLLSHVTVGIRVLDVNDNPPEL |
| Cad15 | EC1 | RVRRAWVIPPISVSENHKRLPYPLVQIKSDKQQ---LGSVIYSIQGPGVDEEPRGVFSIDKFTGKV-FLNAMLDREKTDR---FRLRAFALDLGG--STLEDPTDLEIVWDQNDNRPAF |
| Cad15 | EC2 | ----LQEAFTGRVLEGA-VPGTYTYTRAEATDADDPETDNAALRFSILQQGSPE----IFRINENTGSV-SVTRTLDREVIAV----YNLTLQVA-D-MSGDGLTATASAIITLDDINDNAPEF |
| Tcad | EC1 | -RQKRSIVVSPILPENQRQPFPRDVGKVWDSDRPERSKFRLTGKGVDQEPKG----IFRINENTGSV-SVTRTLDREVIAV----YQLFVETTDVNG---KTLEGVPPLEVIVIDQNDNRPIF |
| PBcad | EC1 | RVKRGWVWNQFFVEEYTGTEPLYVGKIHSDSDEGD---GTIKYTISGEGAG----TIFLIDELTGDI-HATERLDREQKTF----YTLRAQARDRAT--NRLLEPESEFIIKVQDINDSEPRF |
| PBcad | EC2 | ----LHGPYTGSVAELS-PTGTSVMQVMASDADDPTYGSSARLVYSVLDGEH-----HFTVDPKTGVIRTAVPDLDRESQER----YEVVIQATDMAG-QLGGLSGTTVTLTDVNDNPPRF |
| PBcad | EC4 | ----RPPSGLLEVQEDA-QVGSLVGVVTARDPDAAN---RPVRYATDRDSDLE---QIFDIDADTGAI-VTGKGLDRETAGW----HNITVLAMEADN---HAQLSRASLRIRILDVNDNPPEL |
| LIcad | EC2 | ----LQSKYEGSVRQNS-RPGKPFLYNATDLDDPATPNGQLYYQIVIQLPMINNVMYFQINNNKTGAI-SLTREGSQELNPAKNPYNLVISVKDMGGQSENSFSDTSVDIIVTENIWKAPAP |
| Pcd43 | EC3 | ----NQSLYRARVPGGC-TSGTRVWQVLAITDLDEGP--NGEIIYSFGSHNRAGVR-QLFALDLVTGML-TIKGRLDFEDTKL----HEIYIQAKOKGA---NPEGAHCKVLVEVDVNDNAPEI |

*Fig. 2A*

```
Pcd43  EC5  ----SQSSYDVYIEENN-LPGAPILNLSVWDPDAPQN-ARLSFFLLEQGAFTGLVGRYFTINRDNGIV-SSLVPLDYEDRRE----FELTAHISDGGT---PVLATNISVNIFVTDRNDNAPQV
Pcd68  EC3  ----EAPSYLVELPENT-PLGTVVIDLNATDADEGP--NGEVLYSFSSYYPDRVR-ELFSIDPKTGLI-RVKGNLDYEENGM----LEIDVQARDLGP---NLIPAHCKVTVKLIDRNDNAPSI
Pcd68  EC6  VLPTLQNDTAELQVPRNAGLGYLVSTVRALDSDFGE--SGRLTYEIVDGNDD----HLFEIDPSSGEI-RTLHPFWEDVTPV----VELVWKVTDHGKPT----------------------
Dsg1   EC1  RQKREWIKFAAACREGEDNSKRNPIAKIHSDCAAN----QQVTYRISGVGIDQPPYGIFVINQKTGEI-NITSIVDREVTPF----FIIYCRALNSMG---QDLERPLELRVRVLDINDPPVF
Dsg1   EC2  ----SMAITFAGQIEENS-NANTLVMILNATDADEPNNLNSKIAFKIIRQEPSDSP-MFIINRNTGEIRTMNNFLDREQYGQ----YALAVRGSDRDG-GADGMSAECECNIKILDVNDNIPYM
Dsg2   EC2  ----TQDVFVGSVEELS-AAHTLVMKINATDADEPNTLNSKISYRIVSLEPAYPP--VFYLNKDTGEIYTTSVTLDREEHSS----YTLTVEARDGNGEVTDKPYKQAQVQIRILDVNDNIPVV
Dsc1   EC1  ----RWAPIPASLMENSLGPFPQHVQQIQSDAAQN----YTIFYSISGPGVDKEPNLFYIEKDTGDI-FCTRSIDREKYEQ----FALYGYATTADG--YAPEYPLP-LIIKIEDDNDNAPY
Dsc2   EC1  ----RWAPIPCSMLENSLGPFPLFLQQVESDTAQN----YTIYYSIRGPGVDQEPRNLFYVERDTGNL-YCTRPVDREQYES----FEIIAFATTPDG--YTPELPLP-LIIKIEDENDNYPI
Dsc3   EC1  ----RWAPIPCSMQENSLGPFPLFLQQVESDAAQN----YTVFYSISGRGVDKEPLNLFYIERDTGNL-FCTRPVDREEYDV----FDLIAYASTADG--YSADLPLP-LPIRVEDENDNHPV
Dsc4   EC1  ----RWAPIPCSMQENSLGPFPLFLQQVESDAAQN----YTVFYSISGRGVDKEPLNLFYIERDTGNL-FCTRPVDREEYDV----FDLIAYASTADG--YSADLPLP-LPIRVEDENDNHPV
Cnr1   EC3  ----DRSLYTVKLPENV-PNGTLVVKVNASDLDEGV--NGDIMYSFSTDISPNVK-YKFHIDPVSGEI-IVKGYIDFEECKS----YEILIEGIDKGQ--LPLSGHCKVIVQVEDINDVPEL
Cnr2   EC3  ----QHPEYEVRILENS-DNGTTVIRLNASDKDEGT--NSAISYSFNRLVPPKTL-EQFSIDADTGEI-ITQGNLDFEQVDV----YKIHVDATDKGH--PPMVGHCTVLVKVLDENDNVPQI
Cnr3   EC3  ----DRAIYRVKLVENA-RNGTVVIRLNASDLDEGS--NGQILYSFAADVSPKTE-ATHHIDSVSGEI-KVNGKIDFEETNL----WKIQAEAVDKGS--PPMFGHCTILIEVLDINDNAPKI
Cnr5   EC3  ----DRFVYKVKVLEDA-LNGTLVINLNATDPDEGI--NGDIIYSFRRPVSPAVV-HAFNIDSNSGEV-RTKGLLDFEEIKL----YEIPVEAVDKGN---IPMTGHCTLLVELLDVNDNAPEV
Cnr6   EC3  ----DKSIYNVRLLENT-PNGTLVIKLNASDADEGI--NKEILYFFSNLVLDDVK-SKFTIDSSSGEI-KVKGELDYEDCKV----YEINIDAVDRSA--FPLAGHCKIIVKLVDVNDNVPEM
Cnr7   EC3  ----DHLEYKVRIMENA-AKETLVITLNATDLDEGA--NGQLVYSLMS-IKPTGRH-LFTLDEKNGEL-RVNGTLDYEENKL----YELEVLATDKGT--PPMVGHCVVLVEILDTNDNSPEV
Cnr8   EC3  ----DRSVYEVKMYENQ-ENKTLVIWLNATDSDEGI--NKEVEYSFSSLASSIR--QKFLINEKTGEI-KINGAIDFEESNN----YEIHVDATDKGY--PPMVAHCTVLVEILDENDNAPEI
```

Fig. 2B

```
Human Dsg1  EWIKFAAACREGEDNSKRNPIAKIHSDCAAN--QQVTYRISGVGIDQPPYGIFVINQKTGEINITSIVDREVTPFFIIYCRALNSMGQDLERPLELRVRVLDINDNPPVF
Bull Dsg1   EWIKFAAACREGEDNSKRNPIAKIHSDCAAN--QQVTYRISGVGIDQPPYGIFVINQKTGEINITSIVDREVTPFFIIYCRALNSLGQDLEKPLELRVRVLDINDNPPVF
Human Dsg2  AWITAPVALREGEDLSKKNPIAKIHSDLAEERGLKITKYTGKGITEPPFGIFVFNKDTGELNVTSILDREETPFFLLTGYALDARGNNVEKPLELRIKVLDINDNEPVF
Human Dsg3  EWVKFAKPCREGEDNSKRNPIAKITSDYQAT--QKITYRISGVGIDQPPFGIFVVDKNTGDINITAIVDREETPSFLITCRALNAQGLDVEKPLILTVKILDINDNPVF
Mouse Dsg3  EWVKFAKPCREREDNSRRNPIAKITSDFQKN--QKITYRISGVGIDQPPFGIFVVDPNNGDINITAIVDREETPSFLITCRALNALGQDVERPLILTVKILDVNDNPPIF
Human Dsc1  RWAPIPASLMENSLGPFPQHVQQIQSDAAQN--YTIFYSISGPGVDKEPFNLFYIEKDTGDIFCTRSIDREKYEQFALYGTATTADGYAPEYPLPLIIKIEDDNDNAPYF
Mouse Dsc1  RWAPIPCSLMENSLGPFPQHIQQIQSDAAQN--YTIFYSISGPGDDKEPYNLFYIEKDTGDIYCTRSIDREQIDQFLVYGTATTADGYAPDYPLPLLFKVEDDNDNAPYF
Bull Dsc1   RWAPIPCSLMENSLGPFPQHVQQVQSDAAQN--YTIFYSISGPGVDKEPFNLFFIEKDTGDIFCTRSIDREQYQEFPIYAZATTADGYAPEYPLPLVFKVEDDNDNAPYF
Human Dsc2  RWAPIPCSMLENSLGPFPLFLQQVQSDTAQN--YTIYYSIRGPGVDQEPRNLFYVERDTGNLFCTRPVDREQXESFEIIAFATTPDGYTPELPLPLIIKIEDENDNYPIF
Dog Dsc2    RWAPIPCSMQENSLGPFPLFLQQIQSDTAQN--YTIFYSIRGPGVDREPKNLFYVERDTGNLFCTRPVDREESFELIAFATTPDGYTPELPLPLVIRIEDENDNYPIF
Human Dsc3  RWAPIPCSMQENSLGPFPLFLQQVESDAAQN--YTVFYSISGRGVDKEPLNLFYIERDTGNLFCTRPVDREEXDVFDLIAYASTADGYSADLPLPLPIRVEDENDNHPVF
Mouse Dsc3  RWAPIPCSMQENSLGPFPLFLQQVQSDAAQN--YTVFYSISGRGADQEPLNWFFIERDTGNLFFIERDTGNLFCTRPVDREEXDVFDLIAYASTADGYSADLPLPIKIEDENDNYPLF
Bull Dsc3   RWAPIPCSMQENSLGPFPLFLQQVQSDAAQN--YTIFYSISGRGVDKEPLNLFYIERDTGNLYCTQPVDREEXDVFDLIAYASTADGYSADFPLPLPIRVEDENDNHPIF
Human Dsc4  RWAPIPCSMQENSLGPFPLFLQQVESDAAQN--YTVFYSISGRGVDKEPLNLFYIERDTGNLFCTRPVDREEXDVFDLIAYASTADGYSADLPLPLPIRVEDENDNHPVF
```

Fig. 3

COMPOUNDS AND METHODS FOR MODULATING DESMOSOMAL CADHERIN-MEDIATED FUNCTIONS

CROSS-REFERENCE TO RELATED APPLICATION

This application is a continuation-in-part of U.S. patent application Ser. No. 09/187,859, filed Nov. 6, 1998, now U.S. Pat. No. 6,358,920 which is a continuation-in-part of U.S. patent application Ser. No. 09/073,040, filed May 5, 1998 now U.S. Pat. No. 6,472,367.

TECHNICAL FIELD

The present invention relates generally to methods for modulating desmosomal cadherin-mediated functions, and more particularly to the use of modulating agents derived from desmocollin and desmoglein cell adhesion recognition sequences for inhibiting or enhancing functions mediated by such desmosomal cadherins.

BACKGROUND OF THE INVENTION

Cadherins are a rapidly expanding superfamily of calcium-dependent cell adhesion molecules (CAMs) (for review, see Munro et al., In: *Cell Adhesion and Invasion in Cancer Metastasis*, P. Brodt, ed., pp. 17–34, RG Landes Co., Austin Tex., 1996). All cadherins appear to be membrane glycoproteins that generally promote cell adhesion through homophilic interactions (a cadherin on the surface of one cell binds to an identical cadherin on the surface of another cell), although cadherins also appear to be capable of forming heterotypic complexes with one another under certain circumstances and with lower affinity.

There are many different types of cadherins. The most extensively studied group of cadherins is known as the classical, or type I, cadherins. Classical cadherins have been shown to regulate epithelial, endothelial, neural and cancer cell adhesion, with different cadherins expressed on different cell types. All classical cadherins have a similar structure. As illustrated in FIG. 1A, classical cadherins are composed of five extracellular domains (EC1–EC5), a single hydrophobic domain (TM) that transverses the plasma membrane (PM), and two cytoplasmic domains (CP1 and CP2). The calcium binding motifs DXNDN (SEQ ID NO:1), DXD and LDRE (SEQ ID NO:2) are interspersed throughout the extracellular domains, and each 110 amino acid region that contains such motifs is considered a cadherin repeat. The first extracellular domain (EC1) contains the cell adhesion recognition (CAR) sequence, HAV (His-Ala-Val), along with flanking sequences on either side of the CAR sequence that play a role in conferring specificity. Synthetic peptides containing the HAV sequence and antibodies directed against such peptides have been shown to inhibit classical cadherin-dependent processes (Munro et al., supra; Blaschuk et al., *J. Mol. Biol.* 211:679–82, 1990; Blaschuk et al., *Develop. Biol.* 139:227–29, 1990; Alexander et al., *J. Cell. Physiol* 156:610–18, 1993).

Cadherins that contain calcium binding motifs within extracellular domain cadherin repeats, but do not contain an HAV CAR sequence, are considered to be nonclassical cadherins (illustrated in FIGS. 1B to 1AA). To date, nine groups of nonclassical cadherins have been identified (types II–X). These cadherins are also membrane glycoproteins. Type II, or atypical, cadherins include OB-cadherin (cadherin-11; see Getsios et al., *Developmental Dynamics* 211:238–247, 1998; Simonneau et al., *Cell Adhesion and Communication* 3:115–130, 1995; Okazaki et al., *J. Biological Chemistry* 269:12092–12098, 1994), cadherin-5 (VE-cadherin; see Navarro et al., *J. Cell Biology* 140:1475–1484, 1998), cadherin-6 (K-cadherin; see Shimoyama et al., *Cancer Research* 55:2206–2211, 1995; Shimazui et al., *Cancer Research* 56:3234–3237, 1996; Inoue et al., *Developmental Dynamics* 211:338–351, 1998; Getsios et al., *Developmental Dynamics* 211:238–247, 1998), cadherin-7 (see Nakagawa et al., *Development* 121:1321–1332, 1995), cadherin-8 (see Suzuki et al., *Cell Regulation* 2:261–270, 1991), cadherin-12 (Br-cadherin; see Tanihara et al., *Cell Adhesion and Communication* 2:15–26, 1994), cadherin-14 (see Shibata et al., *J. Biological Chemistry* 272:5236–5240, 1997), cadherin-15 (M-cadherin; see Shimoyama et al., *J. Biological Chemistry* 273:10011–10018, 1998), and PB-cadherin (see Sugimoto et al., *J. Biological Chemistry* 271:11548–11556, 1996). For a general review of atypical cadherins, see Redies and Takeichi, *Developmental Biology* 180:413–423, 1996 and Suzuki et al., *Cell Regulation* 2:261–270, 1991.

Types III–X include LI-cadherin (type III; see Berndorff et al., *J. Cell Biology* 125:1353–1369, 1994), T-cadherin (type IV; see Ranscht, U.S. Pat. No. 5,585,351; Tkachuk et al., *FEBS Lett.* 421:208–212, 1998; Ranscht et al., *Neuron* 7:391–402, 1991; Sacristan et al., *J. Neuroscience Research* 34:664–680, 1993; Vestal and Ranscht, *J. Cell Biology* 119:451–461, 1992; Fredette and Ranscht, *J. Neuroscience* 14:7331–7346, 1994; Ranscht and Bronner-Fraser, *Development* 111:15–22, 1991), protocadherins (type V; e.g., protocadherins 42, 43 and 68; see Sano et al., *EMBO J.* 12:2249–2256, 1993; GenBank Accession Number AF029343), desmocollins (type VI; e.g., desmocollins 1, 2, 3 and 4; see King et al., *Genomics* 18:185–194, 1993; Parker et al., *J. Biol Chem.* 266:10438–10445, 1991; King et al., *J. Invest. Dermatol* 105:314–321, 1995; Kawamura et al., *J. Biol Chem.* 269:26295–26302, 1994), desmogleins (type VII; e.g., desmogleins 1 and 2; see Wheeler et al., *Proc. Natl Acad. Sci. USA* 88:4796–4800; Koch et al., *Eur. J. Cell. Biol* 55:200–208, 1991), and cadherin-related neuronal receptors (type X; see Kohmura et al., *Neuron* 20:1137–1151, 1998).

Most studies of nonclassical cadherins have focused on atypical or type II cadherins. The structure of such cadherins is similar to that of the type I cadherins, but they do not contain the CAR sequence, HAV (FIG. 1B). Atypical cadherins appear to mediate a wide variety of functions. Additional variation is seen in the structures of types III–X cadherins. Although less studied, such cadherins also appear to play a role in diverse functions. Desmosomal cadherins, for example, are present within desmosomes, the intercellular junctions that provide adhesion and membrane anchors for the intermediate filament cytoskeleton. These cadherins (e.g., desmogleins and desmocollins) play a role in desmosomal adhesion, which is critically important for normal tissue construction and epidermis structure. Abnormal desmosomes appear in certain types of carcinomas and other skin disorders (see Chidgey, *Histol Histopathol.* 12:1159–1168, 1997).

Notwithstanding these recent advances, nonclassical cadherin function remains poorly understood at the biological and molecular levels. Accordingly, there is a need in the art for identifying sequences involved in modulating nonclassical cadherin-dependent functions, such as cell adhesion mediated by desmosomal cadherins, and for the development of methods employing such sequences to inhibit processes such as cell adhesion. The present invention fulfills these needs and further provides other related advantages.

SUMMARY OF THE INVENTION

Briefly stated, this invention provides compositions and methods for modulating desmosomal cadherin-mediated functions, such as cell adhesion. Within certain aspects, modulating agents are provided. Such agents are capable of modulating (i.e., inhibiting or enhancing) one or more functions mediated by the desmosomal cadherins desmoglein (dsg) or desmocollin (dsc). A modulating agent may comprise at least one of: (a) a native dsc or dsg CAR sequence; (b) an analogue of such a CAR sequence that is capable of modulating dsc- or dsg-mediated cell adhesion; (c) a non-peptide peptidomimetic of a dsg or dsg CAR sequence that is capable of modulating dsc- or dsg-mediated cell adhesion; (d) an antibody, or antigen-binding fragment thereof, that specifically binds a dsc or dsg CAR sequence; and/or (e) a polynucleotide encoding a native dsc or dsg CAR sequence or analogue thereof that is capable of modulating dsc- or dsg-mediated cell adhesion. Certain preferred modulating agents comprise a desmoglein-1, desmoglein-2, desmoglein-3, desmocollin-1, desmocoffin-2, desmocollin-3 or desmocollin-4 CAR sequence, or an analogue of any of the foregoing CAR sequences. An analogue is generally a peptide sequence that is at least 50% identical to a dsg or dsc CAR sequence, and (i) detectably inhibits a function that is modulated by the dsg or dsc; or (ii) detectably enhances adhesion of cells that express the dsg or dsc. Modulating agents preferably contain no more than 85, and preferably no more than 50, consecutive amino acid residues present within the dsg or dsc. Certain modulating agents comprise a dsg or dsc CAR sequence and are 3–16 amino acid residues in length. Within certain specific embodiments, a modulating agent as described above is a peptide ranging in size from 3 to 50, preferably from 4 to 16, amino acid residues.

For certain modulating agents, the dsg or dsc CAR sequence has the formula:

Aaa-Phe-Baa-Ile/Leu/Val-Asp/Asn/Glu-Caa-Daa-Ser/Thr/Asn-Gly (SEQ ID NO:3)

wherein Aaa, Baa, Caa and Daa are independently selected amino acid residues; Ile/Leu/Val is an amino acid that is selected from the group consisting of isoleucine, leucine and valine, Asp/Asn/Glu is an amino acid that is selected from the group consisting of aspartate, asparagine and glutamate; and Ser/Thr/Asn is an amino acid that is selected from the group consisting of serine, threonine or asparagine. For other modulating agents as described above, the dsg or dsc CAR sequence consists of at least three consecutive amino acid residues, and preferably at least five consecutive amino acid residues, of a region of the dsg or dsc having the formula recited above.

Within certain specific embodiments, a modulating agent as provided herein comprises: (a) one or more desmoglein CAR sequences selected from the group consisting of NQK, NQKT (SEQ ID NO:63), NQKTG (SEQ ID NO:64), INQK (SEQ ID NO:65), INQKT (SEQ ID NO:66), INQKTG (SEQ ID NO:67), VINQK (SEQ ID NO:68), VINQKT (SEQ ID NO:69), VINQKTG (SEQ ID NO:70), FVINQK (SEQ ID NO:71), FVINQKT (SEQ ID NO:72), FVINQKTG (SEQ ID NO:73), IFVINQK (SEQ ID NO:74), IFVINQKT (SEQ ID NO:75), IFVINQKTG (SEQ ID NO:76), NRN, NRNT (SEQ ID NO:77), NRNTG (SEQ ID NO:78), INRN (SEQ ID NO:79), INRNT (SEQ ID NO:80), INRNTG (SEQ ID NO:81), IINRN (SEQ ID NO:82), IINRNT (SEQ ID NO:83), IINRNTG (SEQ ID NO:84), FIINRN (SEQ ID NO:85), FIINRNT (SEQ ID NO:86), FIINRNTG (SEQ ID NO:87), MFIINRN (SEQ ID NO:88), MFIINRNT (SEQ ID NO:89), MFIINRNTG (SEQ ID NO:90), NKD, NKDT (SEQ ID NO:91), NKDTG (SEQ ID NO:92), LNKD (SEQ ID NO:93), LNKDT (SEQ ID NO:94), LNKDTG (SEQ ID NO:95), YLNKD (SEQ ID NO:96), YLNKDT (SEQ ID NO:97), YLNKDTG (SEQ ID NO:98), FYLNKD (SEQ ID NO:99), FYLNKDT (SEQ ID NO:100), FYLNKDTG (SEQ ID NO:101), VFYLNKD (SEQ ID NO:102), VFYLNKDT (SEQ ID NO:103) and VFYLNKDTG (SEQ ID NO:104); or (b) an analogue of any of the foregoing sequences that differs in one or more substitutions, deletions, additions and/or insertions such that that ability of the analogue to modulate a desmoglein-mediated function is not substantially diminished. For example, the agent may comprise a linear peptide having the sequence N—Ac-IFVINQKTG-$NH_2$ (SEQ ID NO:105), N—Ac-MFIINRNTG-$NH_2$ (SEQ ID NO:106) or N—Ac-VFYLNKDTG-$NH_2$ (SEQ ID NO:107). The desmoglein CAR sequence may, but need not, be present within a cyclic peptide.

Within other specific embodiments, a modulating agent as provided herein may comprise: (a) one or more desmocollin CAR sequences selected from the group consisting of EKD, EKDT (SEQ ID NO:108), EKDTG (SEQ ID NO:109), IEKD (SEQ ID NO:110), IEKDT (SEQ ID NO:111), IEKDTG (SEQ ID NO:112), YIEKD (SEQ ID NO:113), YIEDT (SEQ ID NO:114), YIEKDTG (SEQ ID NO:115), FYIEKD (SEQ ID NO:116), FYIEKDT (SEQ ID NO:117), FYIEKDTG (SEQ ID NO:118), LFYIEKD (SEQ ID NO:119), LFYIEKDT (SEQ ID NO:120), LFYIEKDTG (SEQ ID NO:121), ERD, ERDT (SEQ ID NO:122), ERDTG (SEQ ID NO:123), VERD (SEQ ID NO:124), VERDT (SEQ ID NO:125), VERDTG (SEQ ID NO:126), YVERD (SEQ ID NO:127), YVERDT (SEQ ID NO:128), YVERDTG (SEQ ID NO:129), FYVERD (SEQ ID NO:130), FYVERDT (SEQ ID NO:131), FYVERDTG (SEQ ID NO:132), LFYVERD (SEQ ID NO:133), LFYVERDT (SEQ ID NO:134), LFYVERDTG (SEQ ID NO:135), IERD (SEQ ID NO:136), IERDT (SEQ ID NO:137), IERDTG (SEQ ID NO:138), YIERD (SEQ ID NO:139), YIERDT (SEQ ID NO:140), YIERDTG (SEQ ID NO:141), FYIERD (SEQ ID NO:142), FYIERDT (SEQ ID NO:143), FYIERDTG (SEQ ID NO:144), LFYIERD (SEQ ID NO:145), LFYIERDT (SEQ ID NO:146) and LFYIERDTG (SEQ ID NO:147); or (b) an analogue of any of the foregoing sequences that differs in one or more substitutions, deletions, additions and/or insertions such that that ability of the analogue to modulate a desmocollin-mediated function is not substantially diminished. For example, the agent may comprise a linear peptide having the sequence N—Ac-LFYIEKDTG-$NH_2$ (SEQ ID NO:148), N—Ac-LFYVERDTG-$NH_2$ (SEQ ID NO:149) or N—Ac-LFYIERDTG-$NH_2$ (SEQ ID NO:150). The desmocollin CAR sequence may, but need not, be present within a cyclic peptide.

Within other specific embodiments, a modulating agent as provided herein may comprise: (a) one or more Desmoglein-1 CAR sequences selected from the group consisting of: RAL, RALN (SEQ ID NO:151), RALNS (SEQ ID NO:152, RALNSM (SEQ ID NO:153), RALNSL (SEQ ID NO:154), RALNSMG (SEQ ID NO:155), RALNSLG (SEQ ID NO:156), CRAL (SEQ ID NO:157), CRALN (SEQ ID NO:158), CRALNS (SEQ ID NO:159), CRALNSM (SEQ ID NO:160), CRALNSL (SEQ ID NO:161), CRALNSMG (SEQ ID NO:162), CRALNSLG (SEQ ID NO:163), YCRAL (SEQ ID NO:164), YCRALN (SEQ ID NO:165), YCRALNS (SEQ ID NO:166), YCRALNSM (SEQ ID NO:167), YCRALNSL (SEQ ID NO:168), YCRALNSMG (SEQ ID NO:169), YCRALNSLG (SEQ ID NO:170),IYRAL (SEQ ID NO:171), IYRALN (SEQ ID NO:172), IYRALNS (SEQ ID NO:173), IYRALNSM (SEQ ID NO:174), IYRALNSL (SEQ ID NO:175), IYRALNSMG (SEQ ID NO:176) or IYRALNSLG (SEQ ID NO:177); or (b) an analogue of any of the foregoing sequences that differs in one or more substitutions, deletions, additions and/or insertions such that that ability of the analogue to modulate a desmoglein-mediated function is not substantially diminished. Linear peptides having such sequences may be modified at the N- and/or C-termini, as in the peptides N—Ac-IYRALNSMG-$NH_2$ (SEQ ID NO:178) and N—Ac-IYRALNSLG-$NH_2$ (SEQ ID NO:179).

Within other specific embodiments, a modulating agent as provided herein may comprise: (a) one or more Desmoglein-2 CAR sequences selected from the group consisting of: YAL, YALD (SEQ ID NO:180), YALDA (SEQ ID NO:181), YALDAR (SEQ ID NO:182), YALDARG (SEQ ID NO:183), GYAL (SEQ ID NO:184), GYALD (SEQ ID NO:185), GYALDA (SEQ ID NO:186), GYALDAR (SEQ ID NO:187), GYALDARG (SEQ ID NO:188), TGYAL (SEQ ID NO:189), TGYALD (SEQ ID NO:190), TGYALDA (SEQ ID NO:191), TGYALDAR (SEQ ID NO:192), TGYALDARG (SEQ ID NO:193), LTGYAL (SEQ ID NO:194), LTGYALD (SEQ ID NO:195), LTGYALDA (SEQ ID NO:196), LTGYALDAR (SEQ ID NO:197) or LTGYALDARG (SEQ ID NO:198); or (b) an analogue of any of the foregoing sequences that differs in one or more substitutions, deletions, additions and/or insertions such that that ability of the analogue to modulate a desmoglein-mediated function is not substantially diminished. Linear peptides having such sequences may be modified at the N- and/or C-termini, as in the peptides N—Ac-LTGYALDARG-$NH_2$ (SEQ ID NO:199).

Within other specific embodiments, a modulating agent as provided herein may comprise: (a) one or more Desmoglein-3 CAR sequences selected from the group consisting of: RAL, RALN (SEQ ID NO:151), RALNA (SEQ ID NO:200), RALNAQ (SEQ ID NO:201), RALNAL (SEQ ID NO:202), RALNAQG (SEQ ID NO:203), RALNALG (SEQ ID NO:204), CRAL (SEQ ID NO:157), CRALN (SEQ ID NO:158), CRALNA (SEQ ID NO:205), CRALNAQ (SEQ ID NO:206), CRALNAL (SEQ ID NO:207), CRALNAQG (SEQ ID NO:208), CRALNALG (SEQ ID NO:209), TCRAL (SEQ ID NO:210), TCRALN (SEQ ID NO:211), TCRALNA (SEQ ID NO:212), TCRALNAQ (SEQ ID NO:213), TCRALNAL (SEQ ID NO:214), TCRALNAQG (SEQ ID NO:215), TCRALNALG (SEQ ID NO:216), ITCRAL (SEQ ID NO:217), ITCRALN (SEQ ID NO:218), ITCRALNA (SEQ ID NO:219), ITCRALNAQ (SEQ ID NO:220), ITCRALNAL (SEQ ID NO:221), ITCRALNAQG (SEQ ID NO:222), ITCRALNALG (SEQ ID NO:223); or (b) an analogue of any of the foregoing sequences that differs in one or more substitutions, deletions, additions and/or insertions such that that ability of the analogue to modulate a desmoglein-mediated function is not substantially diminished. Linear peptides having such sequences may be modified at the N- and/or C-termini, as in the peptides N—Ac-ITCRALNAQG-$NH_2$ (SEQ ID NO:224) and N—Ac-ITCRALNALG-$NH_2$ (SEQ ID NO:225).

Within other specific embodiments, a modulating agent as provided herein may comprise: (a) one or more Desmocollin-1 CAR sequences selected from the group consisting of: YAT, YATT (SEQ ID NO:226), YATTA (SEQ ID NO:227), YATTAD (SEQ ID NO:228), YATTADG (SEQ ID NO:229), GYAT (SEQ ID NO:230), GYATT (SEQ ID NO:231), GYATTA (SEQ ID NO:232), GYATTAD (SEQ ID NO:233), GYATTADG (SEQ ID NO:234), AYAT (SEQ ID NO:235), AYATT (SEQ ID NO:236), AYATTA (SEQ ID NO:237), AYATTAD (SEQ ID NO:238), AYATTADG (SEQ ID NO:239), YGYAT (SEQ ID NO:240), YGYATT (SEQ ID NO:241), YGYATTA (SEQ ID NO:242), YGYATTAD (SEQ ID NO:243), YGYAT TADG (SEQ ID NO:244), YAYAT (SEQ ID NO:245), YAYATT)(SEQ ID NO:246), YAYATTA (SEQ ID NO:247), YAYATTAD (SEQ ID NO:248), YAYATTADG (SEQ ID NO:249), LYGYAT (SEQ ID NO:250), LYGYATT (SEQ ID NO:251), LYGYATTA (SEQ ID NO:252), LYGYATTAD (SEQ ID NO:253), LYGYATTADG (SEQ ID NO:254), LYAYAT (SEQ ID NO:255), LYAYATT (SEQ ID NO:256), LYAYATTA (SEQ ID NO:257), LYAYATTAD (SEQ ID NO:258), LYAYATTADG (SEQ ID NO:259), VYGYAT (SEQ ID NO:260), VYGYATT (SEQ ID NO:261), VYGYATTA (SEQ ID NO:262), VYGYATTAD (SEQ ID NO:263), VYGYATTADG (SEQ ID NO:264), VYAYAT (SEQ ID NO:265), VYAYATT (SEQ ID NO:266), VYAYATTA (SEQ ID NO:267), VYAYATTAD (SEQ ID NO:268), VYAYATTADG (SEQ ID NO:269), IYGYAT (SEQ ID NO:270), IYGYATT (SEQ ID NO:271), IYGYATTA (SEQ ID NO:272), IYGYATTAD (SEQ ID NO:273), IYGYATTADG (SEQ ID NO:274), IYAYAT (SEQ ID NO:275), IYAYATT (SEQ ID NO:276), IYAYATTA (SEQ ID NO:277), IYAYATTAD (SEQ ID NO:278) or IYAYATTADG (SEQ ID NO:279); or (b) an analogue of any of the foregoing sequences that differs in one or more substitutions, deletions, additions and/or insertions such that ability of the analogue to modulate a desmocollin-mediated function is not substantially diminished. Linear peptides having such sequences may be modified at the N- and/or C-termini, as in the peptides N—Ac-LYGYATTADG-$NH_2$ (SEQ ID NO:280) N—Ac-LYAYATTADG-$NH_2$ (SEQ ID NO:281) N—Ac-VYGYATTADG-$NH_2$ (SEQ ID NO:28 2) N—Ac-VYAYATTADG-$NH_2$ (SEQ ID NO:283) N—Ac-IYGYATTADG-$NH_2$ (SEQ ID NO:284) and N—Ac-IYAYATTADG-$NH_2$ (SEQ ID NO:285).

Within other specific embodiments, a modulating agent as provided herein may comprise: (a) one or more Desmocollin-2 CAR sequences selected from the group consisting of: FAT, FATT (SEQ ID NO:286), FATTP (SEQ ID NO:287), FATTPD (SEQ ID NO:288), FATTPDG (SEQ ID NO:289), AFAT (SEQ ID NO:290), AFATT (SEQ ID NO:291), AFATTP (SEQ ID NO:292), AFATTPD (SEQ ID NO:293), AFATTPDG (SEQ ID NO:294), IAFAT (SEQ ID NO:295), LAFATT (SEQ ID NO:296), IAFATTP (SEQ ID NO:297), IAFATTPD (SEQ ID NO:298), IAFATTPDG (SEQ ID NO:299), IIAFAT (SEQ ID NO:300), IIAFATT (SEQ ID NO:301), IIAFATTP (SEQ ID NO:302), IIAFATTPD (SEQ ID NO:303), IIAFATTPDG (SEQ ID NO:304), LIAFAT (SEQ ID NO:305), LIAFATT (SEQ ID NO:306), LIAFATTP (SEQ ID NO:307), LIAFATTPD (SEQ ID NO:308), LIAFATTPDG (SEQ ID NO:309); or (b) an analogue of any of the foregoing sequences that differs in one or more substitutions, deletions, additions and/or insertions such that that ability of the analogue to modulate a desmocollin-mediated function is not substantially diminished. Linear peptides having such sequences may be modified at the N- and/or C-termini, as in the peptides N—Ac-IIAFATTPDG-$NH_2$ (SEQ ID NO:310) and N—Ac-LIAFATITDG-$NH_2$ (SEQ ID NO:311).

Within other specific embodiments, a modulating agent as provided herein may comprise: (a) one or more desmocollin-3 or desmocollin4 CAR sequences selected from the group consisting of: YAS, YAST (SEQ ID NO:312), YASTA (SEQ ID NO:313), YASTAD (SEQ ID NO:314), YASTADG (SEQ ID NO:315), AYAS (SEQ ID NO:316), AYAST (SEQ ID NO:317), AYASTA (SEQ ID NO:318), AYASTAD (SEQ ID NO:319), AYASTADG (SEQ ID NO:320), IAYAS (SEQ ID NO:321), IAYAST (SEQ ID NO:322), IAYASTA (SEQ ID NO:323), IAYASTAD (SEQ ID NO:324), IAYASTADG (SEQ ID NO:325), LIAYAS (SEQ ID NO:326), LIAYAST (SEQ ID NO:327), LIAYASTA (SEQ ID NO:328), LIAYASTAD (SEQ ID NO:329), LIAYASTADG (SEQ ID NO:330); or (b) an analogue of any of the foregoing sequences that differs in one or more substitutions, deletions, additions and/or insertions such that that ability of the analogue to modulate a desmocollin-mediated function is not substantially diminished. Linear peptides having such sequences may be modified at the N- and/or C-termini, as in the peptides N—Ac-LIAYASTADG-NH$_2$ (SEQ ID NO:331).

Within other embodiments, a modulating agent comprises a dsc or dsg CAR sequence that is present within a cyclic peptide. Such cyclic peptides may have the formula:

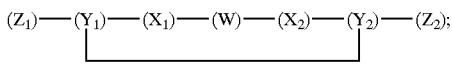

wherein W is a tripeptide selected from the group consisting of NQK, NRN, NKD, EKD, ERD, RAL, YAL, YAT, FAT, and YAS; wherein $X_1$, and $X_2$ are optional, and if present, are independently selected from the group consisting of amino acid residues and combinations thereof in which the residues are linked by peptide bonds, and wherein $X_1$ and $X_2$ independently range in size from 0 to 10 residues, such that the sum of residues contained within $X_1$ and $X_2$ ranges from 1 to 12; wherein $Y_1$ and $Y_2$ are independently selected from the group consisting of amino acid residues, and wherein a covalent bond is formed between residues $Y_1$ and $Y_2$; and wherein $Z_1$ and 4 are optional, and if present, are independently selected from the group consisting of amino acid residues and combinations thereof in which the residues are linked by peptide bonds.

Within other aspects of the present invention, polynucleotides encoding a modulating agent as described above are provided, along with expression vectors comprising such a polynucleotide and host cells transformed or transfected with such an expression vector.

The present invention further provides modulating agents that comprise an antibody or antigen-binding fragment thereof that specifically binds to a dsg or dsc CAR sequence as described above and modulates a desmosomal cadherin-mediated function.

Within further aspects, the present invention provides modulating agents comprising a non-peptide mimetic of any one of the desmosomal cadherin CAR sequences provided above.

In certain embodiments, a modulating agent may be linked to a drug, a detectable marker, a targeting agent and/or a support material. Modulating agents may also, or alternatively, comprise one or more of: (a) a cell adhesion recognition sequence other than a dsc or dsg CAR sequence; and/or (b) an antibody or antigen-binding fragment thereof that specifically binds to a CAR sequence other than a dsc or dsg CAR sequence. For example, such an adhesion molecule may be a classical cadherin, nonclassical cadherin, integrin, occludin, claudin, N-CAM, fibronectin, laminin or other extracellular matrix protein.

Within further aspects, pharmaceutical compositions are provided, comprising a modulating agent as described above, in combination with a pharmaceutically acceptable carrier. Such compositions may additionally comprise a drug and/or one or more of: (a) a peptide comprising a cell adhesion recognition sequence other than a dsc or dsg CAR sequence; and/or (b) an antibody or antigen-binding fragment thereof that specifically binds to a CAR sequence other than a dsc or dsg CAR sequence.

The present invention further provides, within other aspects, methods for modulating one or more desmosomal cadherin-mediated functions. Such methods generally comprise contacting a dsg- or dsc-expressing cell with a modulating agent as described above. Suitable cells include, but are not limited to, epithelial cells, endothelial cells and tumor cells. Within such methods, the modulating agent may, but need not, be present within a pharmaceutical composition as recited above.

The present invention further provides, within other aspects, methods for modulating cell adhesion, comprising contacting a dsc- and/or dsg-expressing cell with a modulating agent or a pharmaceutical composition as described above. Such modulating agents and compositions may inhibit or enhance cell adhesion.

Within other aspects, the present invention provides methods for inhibiting adhesion of dsc- and/or dsg-expressing cells in a mammal, comprising administering to a mammal a modulating agent as described above, wherein the modulating agent inhibits dsc- and/or dsg-mediated cell adhesion.

Within further aspects, the present invention provides methods for enhancing the delivery of a drug through the skin of a mammal, comprising contacting epithelial cells of a mammal with a drug and a modulating agent as described above, wherein the step of contacting is performed under conditions and for a time sufficient to allow passage of the drug across the epithelial cells, and wherein the modulating agent inhibits dsg- or dsc-mediated cell adhesion. Such modulating agents may pass into the blood stream of the mammal. Within certain embodiments, the modulating agent is linked to the drug. The step of contacting may, but need not, be performed via a skin patch comprising the modulating agent and the drug, and such skin patches are further provided herein.

Methods are further provided for facilitating blood sampling in a mammal, comprising contacting epithelial cells of a mammal with a modulating agent as described above, wherein the modulating agent inhibits dsg- or dsc-mediated cell adhesion, and wherein the step of contacting is performed under conditions and for a time sufficient to allow passage of one or more blood components across the epithelial cells. The step of contacting may be performed via a skin patch comprising the modulating agent, and (optionally) a reagent for detecting a blood component of interest, and such kits are specifically provided herein. Within certain embodiments, the epithelial cells are skin cells or are gum cells.

Within further aspects, methods are provided for enhancing the delivery of a drug to a tumor in a mammal, comprising administering to a mammal a modulating agent as described above, wherein the modulating agent inhibits dsg- or dsc-mediated cell adhesion. Suitable tumors include, but are not limited to, bladder tumors, ovarian tumors, breast tumors, stomach tumors and kidney tumors, and the modulating agent may be administered locally to the tumor or may be administered systemically.

Within other aspects, the present invention provides methods for treating cancer in a mammal, comprising administering to a mammal a modulating agent as described above, wherein the modulating agent inhibits dsg- or dsc-mediated cell adhesion. The mammal may be afflicted with a cancer such as a carcinoma, leukemia or melanoma, and the modulating agent may be administered to a tumor or systemically.

The present invention further provides, within other aspects, methods for inducing apoptosis in a desmosomal cadherin-expressing cell, comprising contacting a desmosomal cadherin-expressing cell with a modulating agent as described above, wherein the modulating agent inhibits desmosomal cadherin-mediated cell adhesion.

Within other aspects, the present invention provides methods for enhancing adhesion of desmosomal cadherin-expressing cells, comprising contacting dsg- or dsc-expressing cells with a modulating agent as described above, wherein the modulating agent enhances dsg- or dsc-mediated cell adhesion, wherein the step of contacting is performed under conditions and for a time sufficient to detectably enhance adhesion of the cells. Within certain embodiments, modulating agents for use within such methods are linked to a support molecule or a solid support.

Within related aspects, the present invention provides methods for facilitating wound healing and/or reducing scar tissue in a mammal, comprising contacting a wound in a mammal with a modulating agent as described above, wherein the modulating agent enhances desmosomal cadherin-mediated cell adhesion. Within certain embodiments, modulating agents for use within such methods are linked to a support molecules or a solid support.

Methods are also provided, within other aspects, for enhancing adhesion of foreign tissue implanted within a mammal, comprising contacting a site of implantation of foreign tissue in a mammal with a modulating agent as described above, wherein the modulating agent enhances dsg- or dsc-mediated cell adhesion. Such foreign tissue may be a skin graft or organ implant. Within certain embodiments, modulating agents for use within such methods are linked to a support molecules or a solid support.

Within further aspects, methods are provided for treating an autoimmune blistering disorder in a mammal, comprising administering to a mammal a modulating agent as described above, wherein the modulating agent enhances desmosomal cadherin-mediated cell adhesion. Within certain embodiments, such an agent may be administered topically to a blister. Modulating agents for use within such methods may be linked to a support molecule or a solid support.

The present invention further provides methods for detecting the presence of desmosomal cadherin-expressing cells in a sample, comprising: (a) contacting a sample with an antibody or antigen-binding fragment thereof that binds to a dsg or dsc CAR sequence as described above under conditions and for a time sufficient to allow formation of an antibody-cadherin complex; and (b) detecting the level of antibody-cadherin complex, and therefrom detecting the presence of desmosomal cadherin-expressing cells in a sample. The antibody may be linked to a support material or a detectable marker such as a fluorescent marker. In certain embodiments, the step of detecting is performed using fluorescence activated cell sorting.

Kits for detecting the presence of dsg- or dsc-expressing cells in a sample are also provided. Such kits may comprise: (a) an antibody or antigen-binding fragment thereof that specifically binds to a desmosomal cadherin CAR sequence; and (b) a detection reagent.

Within other aspects, the present invention provides methods for identifying a compound capable of modulating a desmosomal cadherin-mediated function, comprising: (a) contacting an antibody or antigen-binding fragment thereof that specifically binds to a dsg or dsc CAR sequence as described above with a test compound; and (b) detecting the level of antibody or fragment that binds to the test compound, and therefrom identifying a compound capable of modulating desmosomal cadherin-mediated cell adhesion.

These and other aspects of the present invention will become apparent upon reference to the following detailed description and attached drawings. All references disclosed herein are hereby incorporated by reference in their entirety as if each was incorporated individually.

BRIEF DESCRIPTION OF THE DRAWINGS

FIGS. 2A and 2B provide the amino acid sequences of representative mammalian nonclassical cadherin extracellular domains, as indicated (SEQ ID NOs:4–43). Calcium binding motfits are shown on bold, and representative CAR sequences are shown in bold and underlined.

FIG. 3 provides the amino acid sequences of representative mammalian desmosomal cadherin ECI domains, as indicated (SEQ ID Nos:44–57). Amino acids are represented by their IUPAC codes and —represents a gap. The desmosomal cadherin CAR sequence is indicated in bold.

DETAILED DESCRIPTION OF THE INVENTION

Figure 1A:
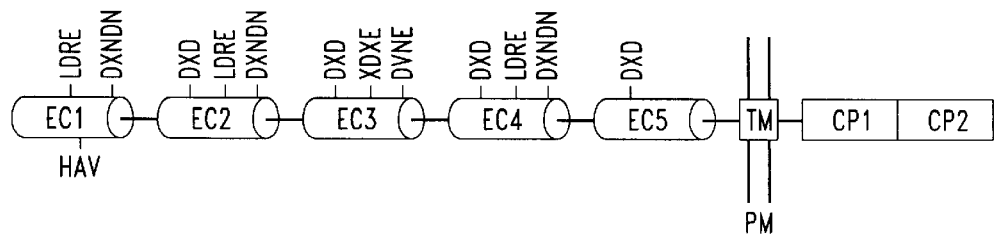
FIGS. 1A–AA are diagrams depicting the structure of classical (FIG. 1A) and nonclassical cadherins. The extracellular domains are designated EC1–EC5 for most cadherins; EC1–EC7 for LI-cadherin and EC1–EC6 for protocadherins and cnr. The hydrophobic domain that transverses the plasma membrane (PM) is represented by TM, and the varying number of cytoplasmic domains are represented by CP. The calcium binding motifs for classical cadherins are shown in FIG. 1A by DXNDN (SEQ ID NO:1), DXD, LDRE (SEQ ID NO:2), DXE, and DVNE (SEQ ID NO:341), and the calcium binding motifs for other cadherins (SEQ ID NO:341–366) are also indicated above the extracellular domains. Below the extracellular domains, the nine amino acid CAR sequences are shown.

As noted above, the present invention provides methods for modulating desmosomal cadherin-mediated functions, such as cell adhesion. The present invention is based, in part, upon the identification of previously unknown cell adhesion recognition (CAR) sequences present in desmosomal cadherins. A modulating agent may comprise one or more such desmosomal cadherin CAR sequences (or analogues or mimetics thereof), with or without one or more additional cell adhesion molecule CAR sequences, as described below. Peptide CAR sequences may be present within a linear or cyclic peptide. Alternatively, or in addition, a modulating agent may comprise a polynucleotide encoding a polypeptide comprising one or more desmosomal cadherin CAR sequences and/or a modulating agent may comprise a substance (such as an antibody or antigen-binding fragment thereof) that specifically binds to a desmosomal cadherin CAR sequence.

In general, to modulate a desmosomal cadherin-mediated function, a cell that expresses a desmosomal cadherin is contacted with a modulating agent either in vivo or in vitro. Within certain aspects, the methods provided herein inhibit a desmosomal cadherin-mediated function. Such methods include, for example, methods for treating diseases or other conditions characterized by undesirable cell adhesion or for facilitating drug delivery to a specific tissue or tumor. Certain methods may inhibit cell adhesion (e.g., cancer cell adhesion). Alternatively, a modulating agent may, such as when linked to a matrix or to another modulating agent via a linker, be used to enhance a desmosomal cadherin-mediated function, such as cell adhesion. Such conjugates may be used, for example, to facilitate wound healing or the adhesion of implants.

Modulating Agents

The term "modulating agent," as used herein, refers to a molecule comprising at least one of the following components:

(a) a linear or cyclic peptide sequence that is at least 50% identical to a desmosomal cadherin CAR sequence (i.e., a desmosomal cadherin CAR sequence or an analogue thereof that retains at least 50% sequence identity);

(b) a mimetic (e.g., peptidomimetic or small molecule mimic) of a desmosomal cadherin CAR sequence;

(c) a substance, such as an antibody or antigen-binding fragment thereof, that specifically binds a desmosomal cadherin CAR sequence; and/or (d) a polynucleotide encoding a polypeptide that comprises a desmosomal cadherin CAR sequence or analogue thereof.

A modulating agent may consist entirely of one or more of the above elements, or may additionally comprise further peptide and/or non-peptide regions. Additional peptide regions may be derived from a desmosomal cadherin (preferably an extracellular domain that comprises a CAR sequence) and/or may be heterologous. Within certain preferred embodiments, a modulating agent contains no more than 85 consecutive amino acid residues, and preferably no more than 50 consecutive amino acid residues, present within a desmosomal cadherin.

A modulating agent is further capable of modulating a function mediated by a desmosomal cadherin. Such activity may generally be assessed using, for example, representative assays provided herein. Certain modulating agents inhibit an interaction between desmosomal cadherin molecules and/or between a desmosomal cadherin and a different adhesion molecule. For functions (e.g., cell adhesion) that are inhibited by a full length desmosomal cadherin, such a modulating agent may inhibit the function with an activity that is not substantially diminished relative to the full length desmosomal cadherin (ie., the modulating agent inhibits the function at least as well as soluble cadherin, when contacted with cells that express the cadherin). For example, a modulating agent may be as effective as soluble desmosomal cadherin in preventing and/or disrupting adhesion of desmosomal cadherin-expressing cells. Alternatively, to enhance adhesion of desmosomal cadherin-expressing cells, a modulating agent may comprise an antibody or antigen-binding fragment thereof and/or multiple peptides or mimetics linked to a support material. Such modulating agents may function as a biological glue to bind desmosomal cadherin-expressing cells, and should result in a detectable enhancement of cell adhesion (preferably an enhancement that is at least as great as that observed for immobilized desmosomal cadherin or antibody directed against the cadherin).

Figure 1B:
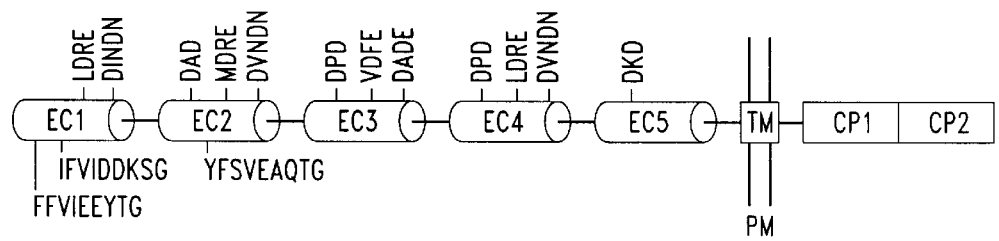
Figure 1C:
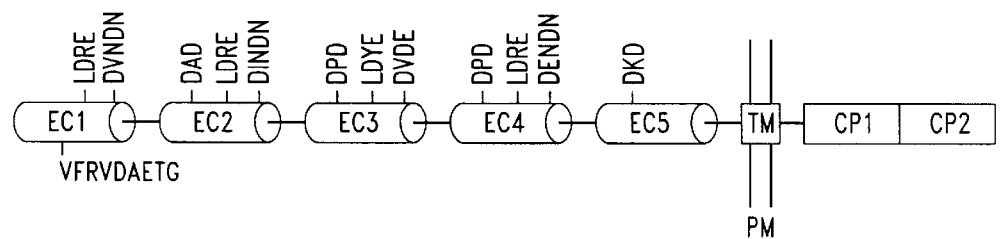
Figure 1D:
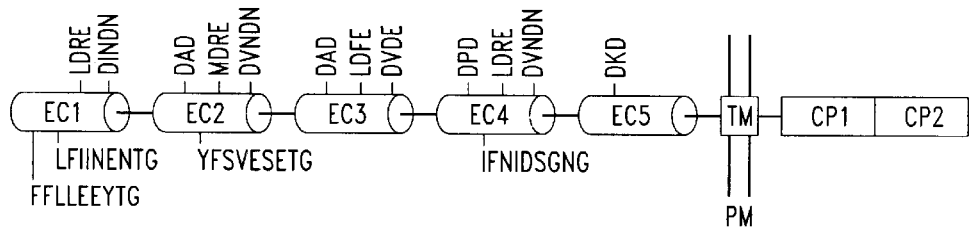
Figure 1E:
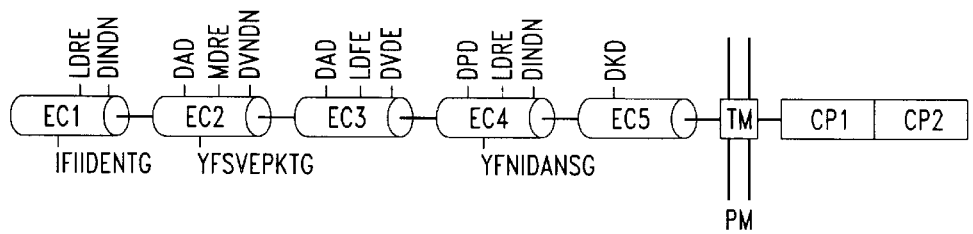
Figure 1F:
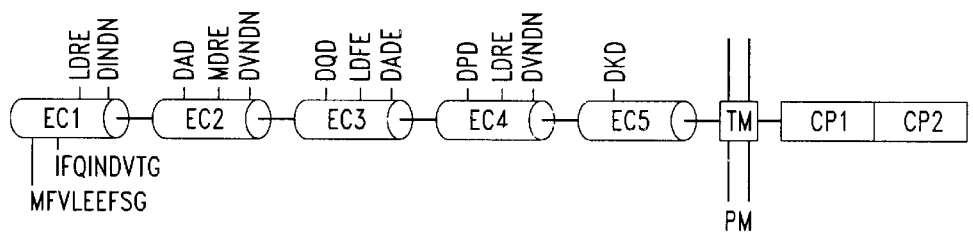
Figure 1G:
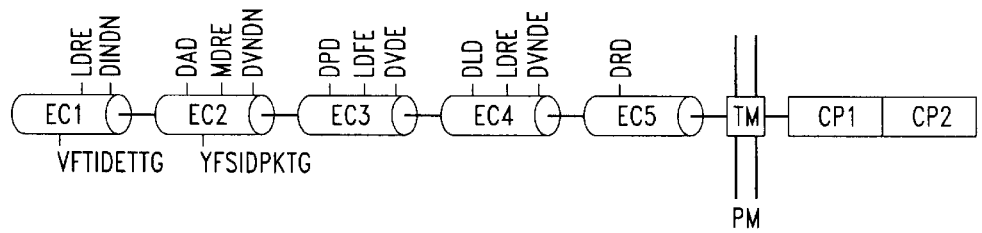
Figure 1H:
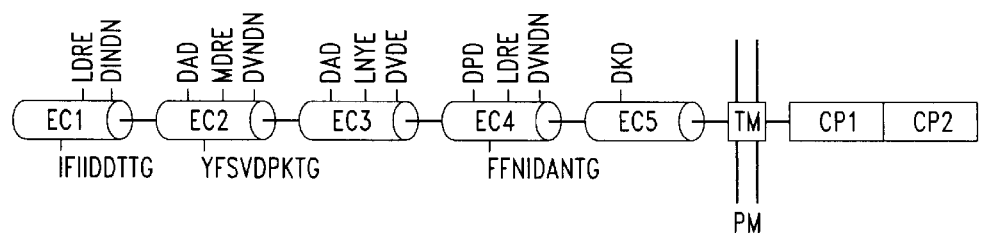
Figure 1I:
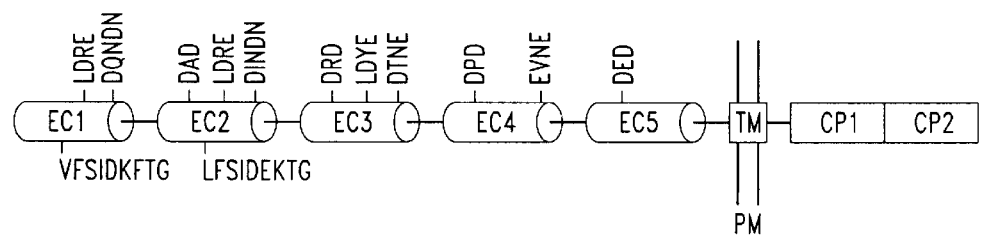
Figure 1J:
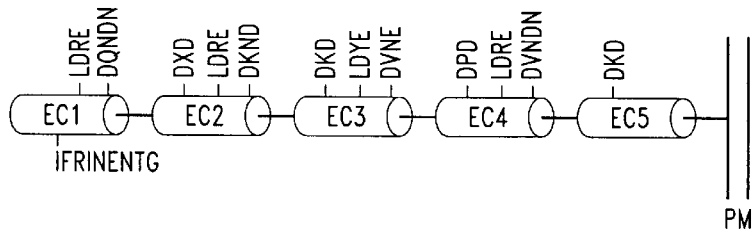
Figure 1K:
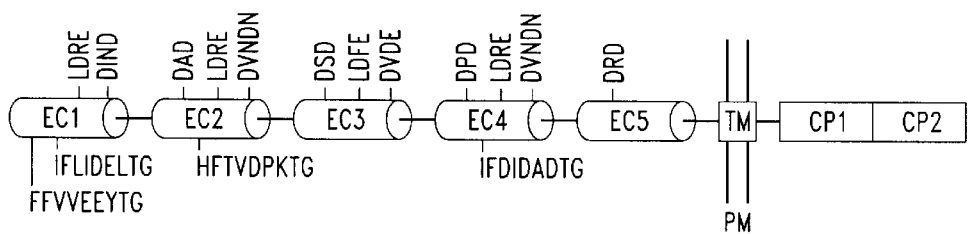
Figure 1L:
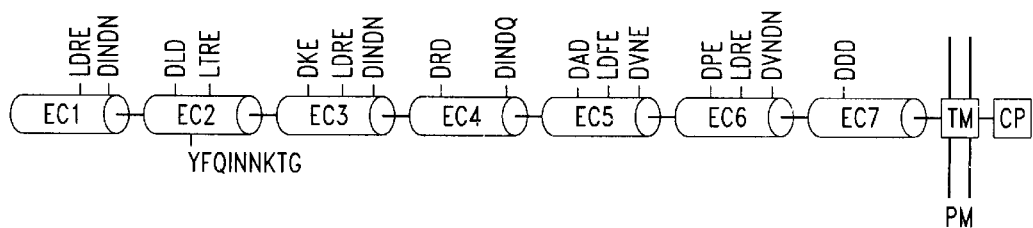
Figure 1M:
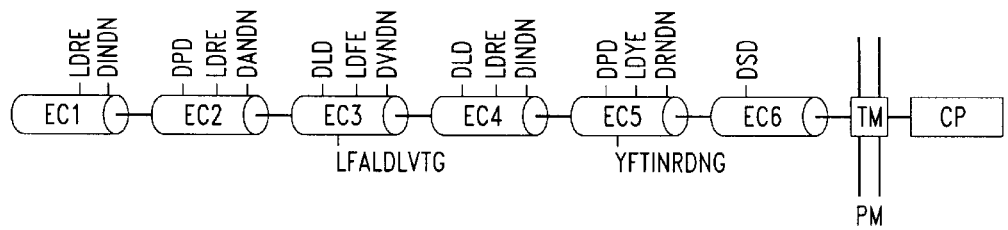
Figure 1N:
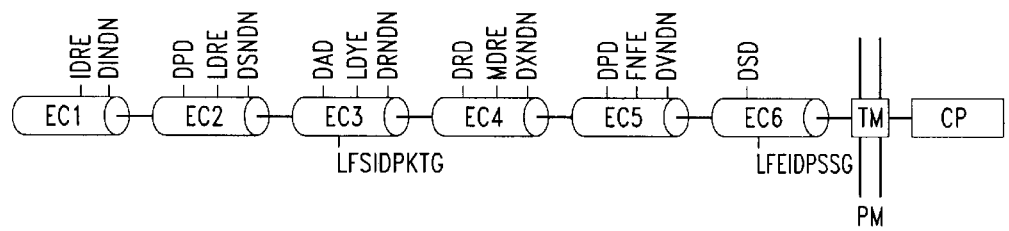
Figure 1O:
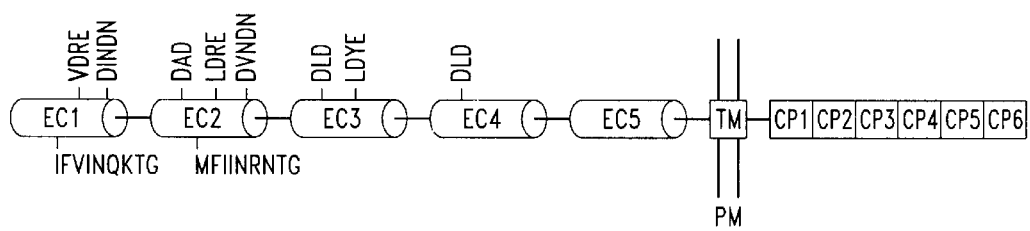
Figure 1P:
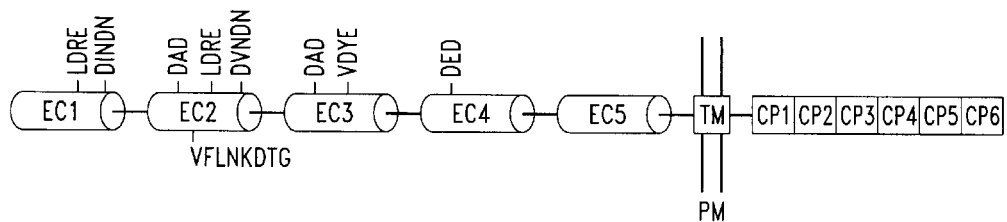
Figure 1Q:
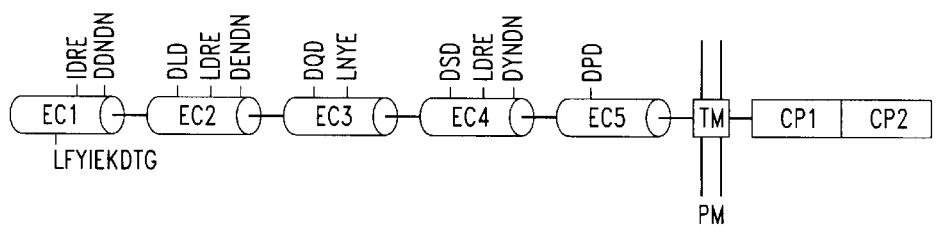
Figure 1R:
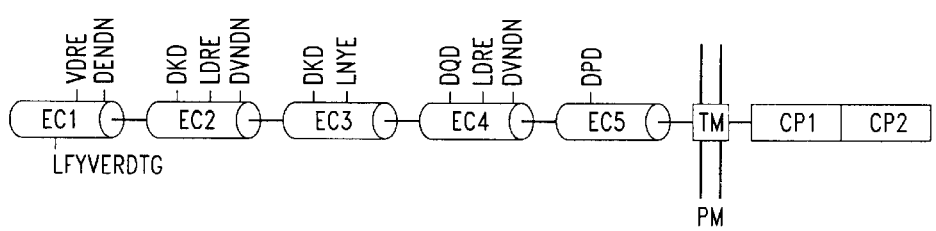
Figure 1S:
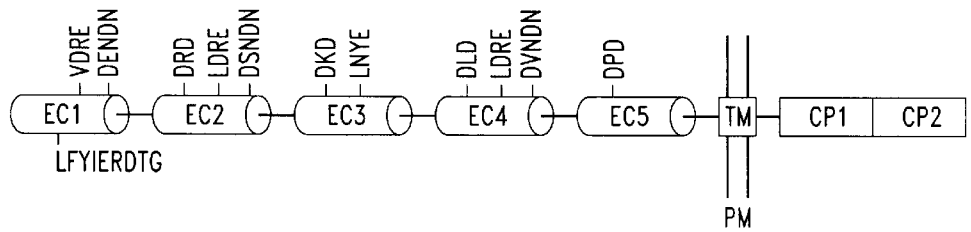
Figure 1T:
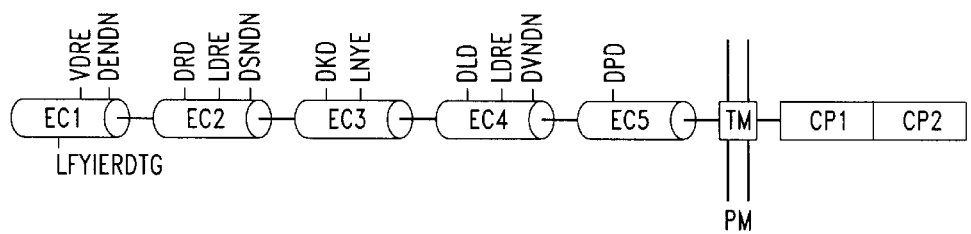
Figure 1U:
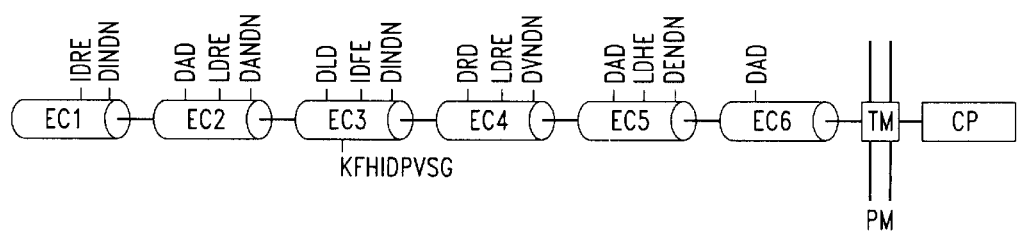
Figure 1V:
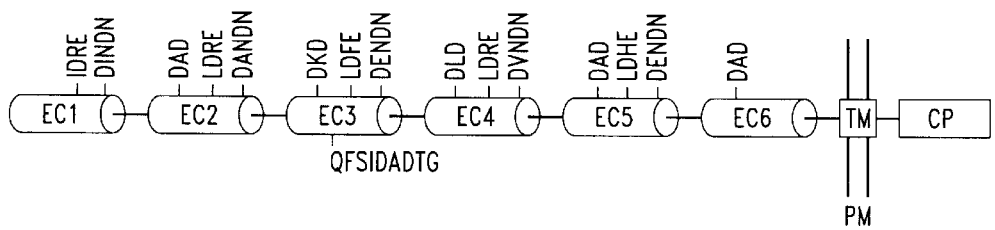
Figure 1W:
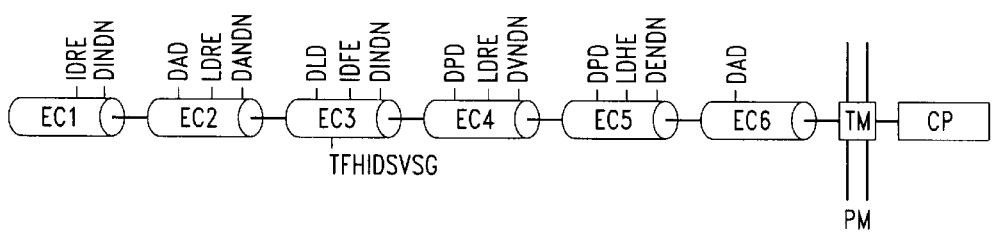
Figure 1X:
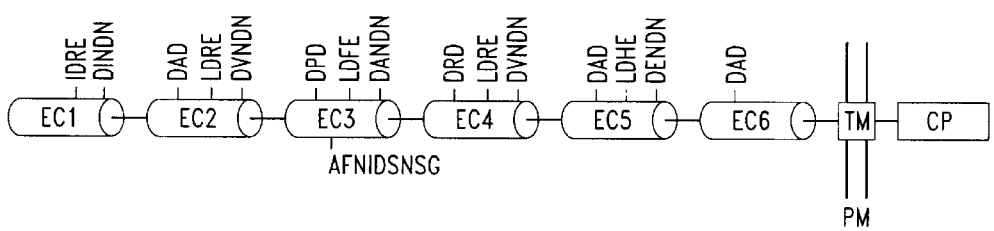
Figure 1Y:
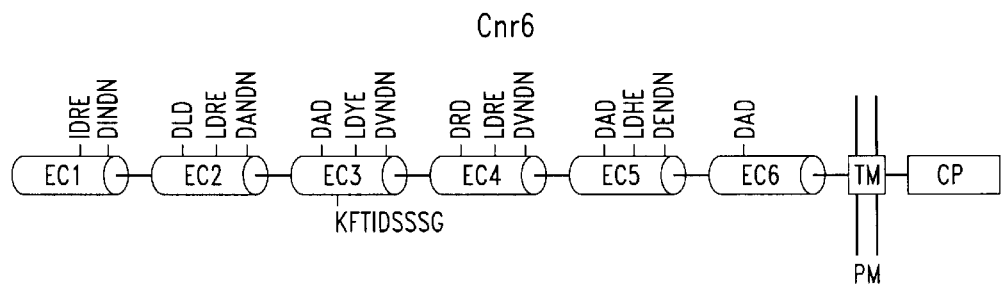
Figure 1Z:
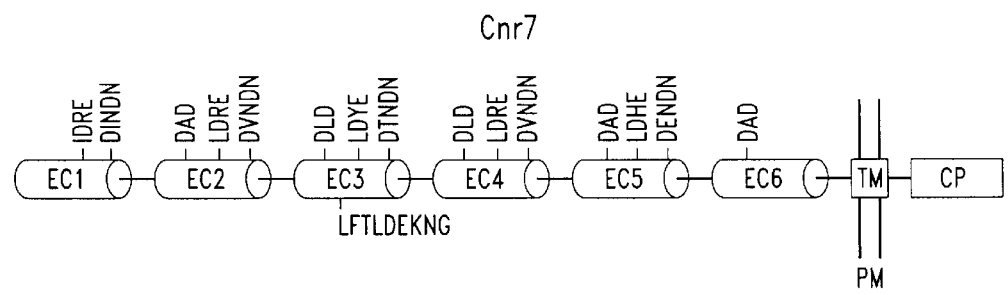
Figure 1A:
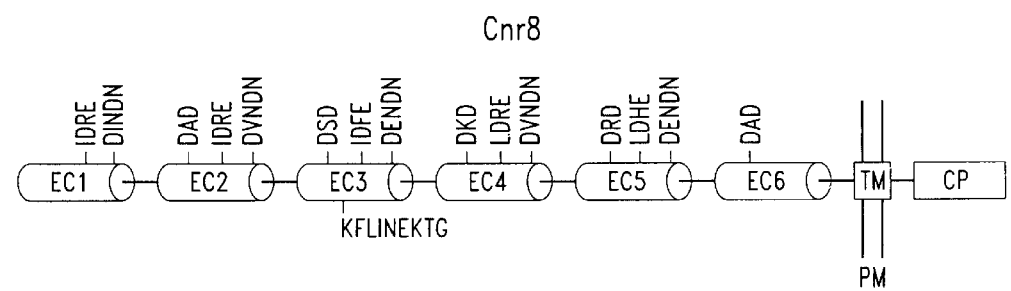
Figure 4:
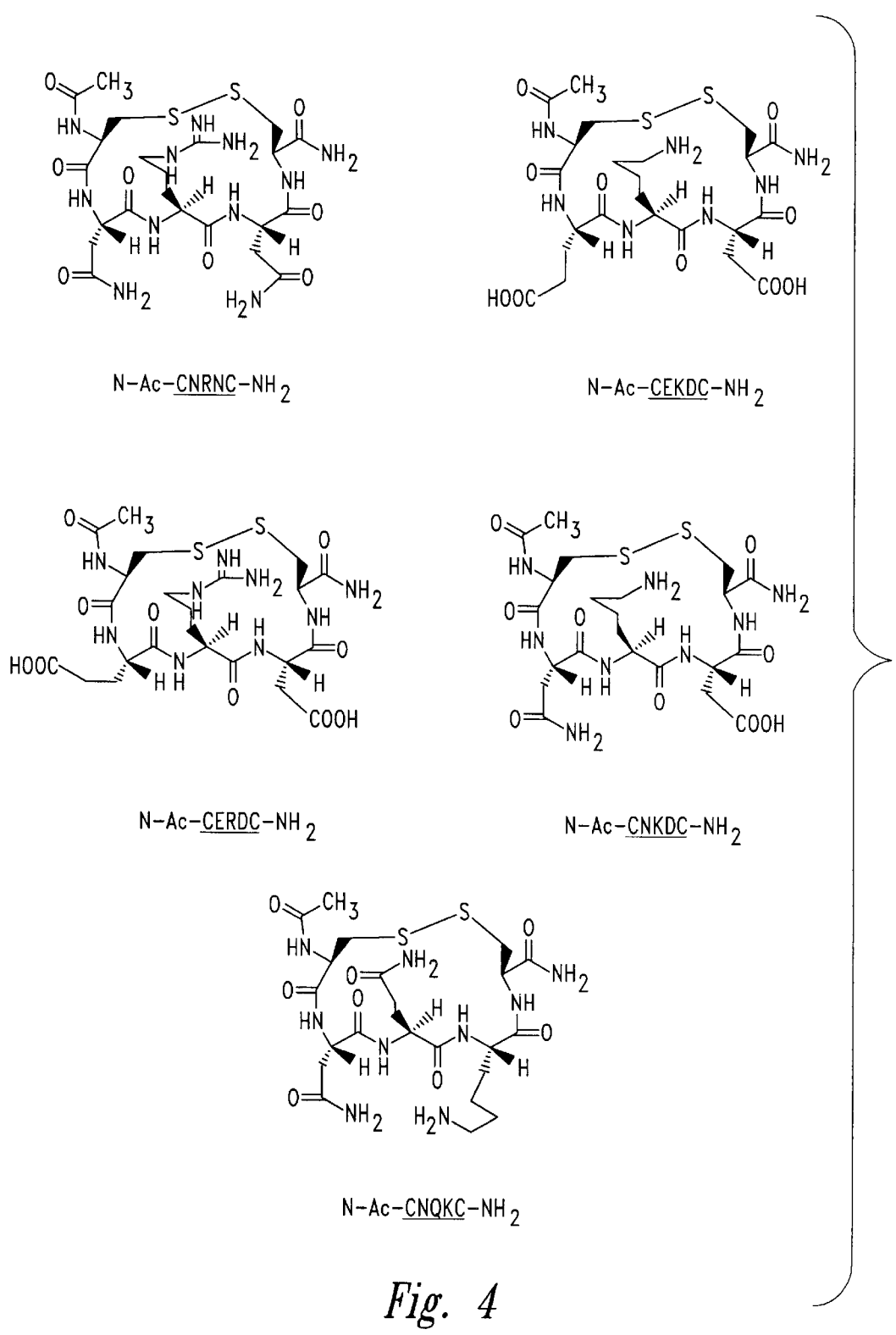
FIG. 4 (SEQ ID Nos:58–62) depicts the structures of representative cyclic peptide modulating agents.

The term "nonclassical cadherin," as used herein, refers to a polypeptide hat contains characteristic cadherin repeats, but does not contain an HAV CAR sequence. As used herein, a "cadherin repeat" refers to an amino acid sequence that is approximately 110 amino acid residues in length (generally 100 to 120 residues, preferably 105 to 115 residues), comprises an extracellular domain, and contains three calcium binding motifs (DXD, XDXE and DXXDX; SEQ ID NOS:332 and 333 respectively) in the same order and in approximately the same position (see, e.g., FIG. 2). The presence of an extracellular domain may generally be determined using well known techniques, such as the presence of one or more of: a hydrophilic sequence, a region that is recognized by an antibody, a region that is cleaved by trypsin and/or a potential glycosylation site with the glycosylation motif Asn-X-Ser/Thr. The second calcium binding motif commonly has the sequence LDRE (SEQ ID NO:2), although variants of this sequence with conservative substitutions are also observed, including MDRE (SEQ ID NO:334), LDFE (SEQ ID NO:335), LDYE (SEQ ID NO:336), IDRE (SEQ ID NO:337), VDRE (SEQ ID NO:338) and IDFE (SEQ ID NO:339). Within most cadherin repeats, the third calcium binding motif has the sequence [L,I,V]-X-[L,I,V]-X-D-X-N-D-[N,H]-X-P (SEQ ID NO:340), wherein residues indicated in brackets may be any one of the recited residues. A preferred third calcium binding motif has the sequence DXNDN (SEQ ID NO:1), although one or both of the D residues may be replaced by an E. Homology among cadherin repeats is generally at least 20%, preferably at least 30%, as determined by the ALIGN algorithm (Myers and Miller, *CABIOS* 4:11–17, 1988). Most cadherins comprise at least five cadherin repeats, along with a hydrophobic domain that transverses the plasma membrane and, optionally, one or more cytoplasmic domains, as shown in FIGS. 1B–1AA. Occasionally, however, a cadherin may substitute an extracellular domain that contains fewer than three calcium binding motifs for one or more of the cadherin repeats. For example, as shown in FIG. 2 (SEQ ID NOs:4–43), the second extracellular domain of LI-cadherin comprises only the first calcium binding motif (DXD). As noted above, atypical, or type II, cadherins include cadherin-5 (VE-cadherin), cadherin-6 (K-cadherin), cadherin-7, cadherin-8, cadherin-11 (OB-cadherin), cadherin-12, cadherin-14, cadherin-15 and PB-cadherin. Types III-X include LI-cadherin, T-cadherin, protocadherins (e.g., protocadherins 42, 43 and 68), desmocollins (e.g., desmocollins 1, 2, 3 and 4), desmogleins (e.g., desmogleins 1 and 2), and cadherin-related neuronal receptors.

The term "desmosomal cadherin" refers to a nonclassical cadherin that is present within the intercellular junction known as the desmosome. Desmosomal cadherins include desmogleins and desmocollins (see e.g., King et al., *Genomics* 18:185–194, 1993; Parker et al., *J. Biol Chem.* 266:10438–10445, 1991; King et al., *J. Invest. Dermatol* 105:314–321, 1995; Kawamura et al., *J. Biol Chem.* 269:26295–26302, 1994; Wheeler et al., *Proc. Natl. Acad. Sci. USA* 88:4796–4800; and Koch et al., *Eur. J. Cell. Biol* 55:200–208, 1991). Desmogleins and desmocollins are expressed by cells that possess desmosomes, such as epithelial cells, cardiac muscle cells and meningeal cells. These cadherins are involved in intercellular adhesion of such cells, and may function in a heterotypic manner, whereby a desmocollin isoform and a desmoglein isoform are both required for adhesion. Desmogleins and desmocollins are involved in a number of autoimmune blistering disorders, such as pemphigus vulgaris, pemphigus foliaceus and intercellular IgA dermatosis, and have been shown to have reduced expression in some human carcinomas. The sequences of various extracellular domains of known desmosomal cadherins are shown in FIGS. 2 and 3 (SEQ ID NOs:4–43 and SEQ ID NOs:44–57).

A desmosomal cadherin CAR sequence, as used herein, is an amino acid sequence that is present within in a naturally occurring desmosomal cadherin and that is capable of detectably modulating a desmosomal cadherin-mediated function, such as cell adhesion, as described herein. In other words, contacting a desmosomal cadherin-expressing cell with a peptide comprising a CAR sequence results in a detectable change in a desmosomal cadherin-mediated function using at least one of the representative assays provided herein. CAR sequences are generally recognized in vivo by a desmosomal cadherin or other adhesion molecule (i.e., a molecule that mediates cell adhesion via a receptor on the cell surface), and are necessary for maximal heterophilic and/or homophilic interaction. CAR sequences may be of any length, but generally comprise at least three amino acid residues, preferably 4–16 amino acid residues, and more preferably 5–9 amino acid residues. A peptide modulating agent may comprise any number of amino acid residues, but preferred agents comprise 3–50 residues, preferably 4–16 residues, and more preferably 6–15 residues.

It has been found, within the context of the present invention, that certain nonclassical cadherin CAR sequences share the consensus sequence:

Aaa-Phe-Baa-Ile/Leu/Val-Asp/Asn/Glu-Caa-Daa-Ser/Thr/Asn-Gly    (SEQ ID NO:3)

Within the consensus sequence, Aaa, Baa, Caa and Daa indicate independently selected amino acid residues; "Ile/Leu/Val" indicates an amino acid that is isoleucine, leucine or valine; "Asp/Asn/Glu" indicates an amino acid that is aspartic acid, asparagine or glutamic acid; and "Ser/Thr/Asn" indicates an amino acid that is serine, threonine or asparagine. Representative desmosomal cadherin CAR sequences, as well as other nonclassical cadherin CAR sequences, are provided within Table I. CAR sequences specifically provided herein further include portions of such representative CAR sequences, as well as longer polypeptides that comprise at least a portion of such sequences. Additional nonclassical cadherin CAR sequences may be identified based on sequence homology to the nonclassical cadherin CAR sequences provided herein, and based on the ability of a peptide comprising such a sequence to modulate a nonclassical cadherin-mediated function within a representative assay described herein. Within certain embodiments, a modulating agent comprises at least three consecutive residues, preferably at least five consecutive residues and more preferably at least seven consecutive residues, of a desmosomal cadherin CAR sequence that satisfies the above consensus sequence. Similarly, if a CAR sequence of a different nonclassical cadherin is used in combination with a desmosomal cadherin CAR sequence, such CAR sequence(s) should comprise at least three consecutive residues, preferably at least five consecutive residues and more preferably at least seven consecutive residues, of a nonclassical cadherin CAR sequence that satisfies the above consensus sequence.

TABLE I

Representative Nonclassical Cadherin CAR Sequences

| Cadherin | CAR Sequence | |
|---|---|---|
| Human OB-cadherin EC1 | FFVIEEYTG | (SEQ ID NO:367) |
| Human OB-cadherin EC1 | IFVIDDKSG | (SEQ ID NO:368) |
| Human OB-cadherin EC2 | YFSVEAQTG | (SEQ ID NO:369) |
| Human cadherin- 5 EC1 | VFRVDAETG | (SEQ ID NO:370) |
| Human cadherin- 6 EC1 | FFLLEEYTG | (SEQ ID NO:371) |
| Human cadherin- 6 EC1 | LFIINENTG | (SEQ ID NO:372) |
| Human cadherin- 6 EC2 | YFSVESETG | (SEQ ID NO:373) |
| Human cadherin- 6 EC4 | IFNIDSGNG | (SEQ ID NO:374) |
| Chicken cadherin-7 EC1 | IFIIDENTG | (SEQ ID NO:375) |
| Chicken cadherin-7 EC2 | YFSVEPKTG | (SEQ ID NO:376) |
| Chicken cadherin-7 EC4 | YFNIDANSG | (SEQ ID NO:377) |
| Human cadherin-8 EC1 | MFVLEEFSG | (SEQ ID NO:378) |
| Human cadherin-8 EC1 | IFQINDVTG | (SEQ ID NO:379) |
| Human cadherin-12 EC1 | VFTIDETTG | (SEQ ID NO:380) |
| Human cadherin-12 EC2 | YFSIDPKTG | (SEQ ID NO:381) |
| Human cadherin-14 EC1 | IFIIDDTTG | (SEQ ID NO:382) |
| Human cadherin-14 EC2 | YFSVDPKTG | (SEQ ID NO:383) |
| Human cadherin-14 EC4 | FFNIDANTG | (SEQ ID NO:384) |

TABLE I-continued

Representative Nonclassical Cadherin CAR Sequences

| Cadherin | CAR Sequence | |
|---|---|---|
| Human cadherin-15 EC1 | VFSIDKFTG | (SEQ ID NO:385) |
| Human cadherin-15 EC2 | LFSIDELTG | (SEQ ID NO:386) |
| Human T-cadherin EC1 | IFRINENTG | (SEQ ID NO:387) |
| Rat PB-cadherin EC1 | FFVVEEYTG | (SEQ ID NO:388) |
| Rat PB-cadherin EC1 | IFLIDELTG | (SEQ ID NO:389) |
| Rat PB-cadherin EC2 | HFTVDPKTG | (SEQ ID NO:390) |
| Rat PB-cadherin EC4 | IFDIDADTG | (SEQ ID NO:391) |
| Human LI-cadherin EC2 | YFQINNKTG | (SEQ ID NO:392) |
| Human protocadherin 43 EC3 | LFALDLVTG | (SEQ ID NO:393) |
| Human protocadherin 43 EC5 | YFTINRDNG | (SEQ ID NO:394) |
| Human protocadherin 68 EC3 | LFSIDPKTG | (SEQ ID NO:395) |
| Human protocadherin 68 EC6 | LFEIDPSSG | (SEQ ID NO:396) |
| Human desmoglein1 EC1 | IFVINQKTG | (SEQ ID NO:397) |
| Human desmoglein1 EC2 | MFIINRNTG | (SEQ ID NO:398) |
| Human desmoglein2 EC2 | VFYLNKDTG | (SEQ ID NO:399) |
| Human desmocollin 1 EC1 | LFYIEKDTG | (SEQ ID NO:400) |
| Human desmocollin 2 EC1 | LFYVERDTG | (SEQ ID NO:401) |
| Human desmocollin 3/4 EC1 | LFYIERDTG | (SEQ ID NO:402) |
| Mouse Cnr1 EC3 | KFHIDPVSG | (SEQ ID NO:403) |
| Mouse Cnr2 EC3 | QFSIDADTG | (SEQ ID NO:404) |
| Mouse Cnr3 EC3 | TFHIDSVSG | (SEQ ID NO:405) |
| Mouse Cnr5 EC3 | AFNIDSNSG | (SEQ ID NO:406) |
| Mouse Cnr6 EC3 | KFTIDSSSG | (SEQ ID NO:407) |
| Mouse Cnr7 EC3 | LFTLDEKNG | (SEQ ID NO:408) |
| Mouse Cnr8 EC3 | KFLINEKTG | (SEQ ID NO:409) |
| CONSENSUS | xFxidxxtG | (SEQ ID NO:3) |
| | v n s | |
| | l e n | |

Nonclassical cadherin CAR sequences are generally physically located within the cadherin molecule in or near the binding site of an adhesion molecule (i.e., within 10 amino acids, and preferably within 5 amino acids). The location of a binding site may generally be determined using well known techniques, such as evaluating the ability of a portion of the nonclassical cadherin to bind to the same nonclassical cadherin or to another adhesion molecule. Any standard binding assay may be employed for such an evaluation. Recognition of a CAR sequence by the nonclassical cadherin or other adhesion molecule results in a measurable effect on an adhesion molecule function, such as cell adhesion. Peptides comprising a CAR sequence generally inhibit such a function unless linked, as described herein, to form an enhancer of adhesion molecule function.

Certain preferred desmosomal cadherin CAR sequences comprise 3–9 amino acid residues of a desmoglein or desmocollin sequence provided in Table I. For example, a CAR sequence may comprise 3, 4 or 5 residues of a 9 amino acid sequence in Table I. Within certain embodiments, a CAR sequence may include at least residues 5–7 of a sequence in Table I. A desmoglein CAR sequence may comprise, for example, one or more of the sequences: NQK, NQKT (SEQ ID NO:63), NQKTG (SEQ ID NO:64), INQK (SEQ ID NO:65), INQKT (SEQ ID NO:66), INQKTG (SEQ ID NO:67), VINQK (SEQ ID NO:68), VINQKT (SEQ ID NO:69), VINQKTG (SEQ ID NO:70), FVINQK (SEQ ID NO:71), FVINQKT (SEQ ID NO:72), FVINQKTG (SEQ ID NO:73), IFVINQK (SEQ ID NO:74), IFVINQKT (SEQ ID NO:75), IFVINQKTG (SEQ ID NO:76), NRN, NRNT (SEQ ID NO:77), NRNTG (SEQ ID NO:78), INRN (SEQ ID NO:79), INRNT (SEQ ID NO:80), INRNTG (SEQ ID NO:81), IINRN (SEQ ID NO:82), IINRNT (SEQ ID NO:83), IINRNTG (SEQ ID NO:84), FIINRN (SEQ ID NO:85), FIINRNT (SEQ ID NO:86), FIINRNTG (SEQ ID NO:87), MFIINRN (SEQ ID NO:88), MFIINRNT (SEQ ID NO:89), MFIINRNTG (SEQ ID NO:90), NKD, NKDT (SEQ ID NO:91), NKDTG (SEQ ID NO:92), LNKD (SEQ ID NO:93), LNKDT (SEQ ID NO:94), LNKDTG (SEQ ID NO:95), YLNKD (SEQ ID NO:96), YLNKDT (SEQ ID NO:97), YLNKDTG (SEQ ID NO:98), FYLNKD (SEQ ID NO:99), FYLNKDT (SEQ ID NO:100), FYLNKDTG (SEQ ID NO:101), VFYLNKD (SEQ ID NO:102), VFYLNKDT (SEQ ID NO:103) and VFYLNKDTG (SEQ ID NO:104). Linear peptides having such sequences may be modified at the N- and/or C-termini, as in the peptides N—Ac-IFVINQKTG-NH$_2$ (SEQ ID NO:105), N—Ac-MFIINRNTG-NH$_2$ (SEQ ID NO:106) and N—Ac-VFYLNKDTG-NH$_2$ (SEQ ID NO:107).

A desmocollin CAR sequence may comprise, for example, one or more of the sequences EKD, EKDT (SEQ ID NO:108), EKDTG (SEQ ID NO:109), IEKD (SEQ ID NO:110), IEKDT (SEQ ID NO:111), IEKDTG (SEQ ID NO:112), YIEKD (SEQ ID NO:113), YIEKDT (SEQ ID NO:114), YIEKDTG (SEQ ID NO:115), FYIEKD (SEQ ID NO:116), FYIEKDT (SEQ ID NO:117), FYIEKDTG (SEQ ID NO:118), LFYIEKD (SEQ ID NO:119), LFYIEKDT (SEQ ID NO:120), LFYIEKDTG (SEQ ID NO:121), ERD, ERDT (SEQ ID NO:122), ERDTG (SEQ ID NO:123), VERD (SEQ ID NO:124), VERDT (SEQ ID NO:125), VERDTG (SEQ ID NO:126), YVERD (SEQ ID NO:127), YVERDT (SEQ ID NO:128), YVERDTG (SEQ ID NO:129), FYVERD (SEQ ID NO:130), FYVERDT (SEQ ID NO:131), FYVERDTG (SEQ ID NO:132), LFYVERD (SEQ ID NO:133), LFYVERDT (SEQ ID NO:134), LFYVERDTG (SEQ ID NO:135), IERD (SEQ ID NO:136), IERDT (SEQ ID NO:137), IERDTG (SEQ ID NO:138), YIERD (SEQ ID NO:139), YIERDT (SEQ ID NO:140), YIERDTG (SEQ ID NO:141), FYIERD (SEQ ID NO:142), FYIERDT (SEQ ID NO:143), FYIERDTG (SEQ ID NO:144), LFYIERD (SEQ ID NO:145), LFYIERDT (SEQ ID NO:146) and LFYIERDTG (SEQ ID NO:147). Linear peptides having such sequences may be modified at the N- and/or C-termini, as in the peptides N—Ac-LFYIEKDTG-NH$_2$ (SEQ ID NO:148), N—Ac-LFYVERDTG-NH$_2$ (SEQ ID NO:149) and N—Ac-LFYIERDTG-NH$_2$ (SEQ ID NO:150).

Further desmosomal cadherin CAR sequences are derived from the EC1 domains recited in FIG. 3. A desmoglein-1 CAR sequence may comprise, for example, one or more of the sequences RAL, RALN (SEQ ID NO:151), RALNS (SEQ ID NO:152), RALNSM (SEQ ID NO:153), RALNSL (SEQ ID NO:154), RALNSMG (SEQ ID NO:155), RALNSLG (SEQ ID NO:156), CRAL (SEQ ID NO:157), CRALN (SEQ ID NO:158), CRALNS (SEQ ID NO:159), CRALNSM (SEQ ID NO:160), CRALNSL (SEQ ID NO:161), CRALNSMG (SEQ ID NO:162), CRALNSLG (SEQ ID NO:163), YCRAL (SEQ ID NO:164), YCRALN (SEQ ID NO:165), YCRALNS (SEQ ID NO:166), YCRALNSM (SEQ ID NO:167), YCRALNSL (SEQ ID NO:168), YCRALNSMG (SEQ ID NO:169), YCRALNSLG (SEQ ID NO:170), IYRAL (SEQ ID NO:171), IYRALN (SEQ ID NO:172), IYRALNS (SEQ ID NO:173), IYRALNSM (SEQ ID NO:174), IYRALNSL (SEQ ID NO:175), IYRALNSMG (SEQ ID NO:176) and IYRALNSLG (SEQ ID NO:177). Linear peptides having such sequences may be modified at the N- and/or C-termini, as in the peptides N—Ac-IYRALNSMG-NH$_2$ (SEQ ID NO:178) and N—Ac-IYRALNSLG-NH$_2$ (SEQ ID NO:179).

A desmoglein-2 CAR sequence may comprise, for example, one or more of the sequences YAL, YALD (SEQ ID NO:180), YALDA (SEQ ID NO:181), YALDAR (SEQ ID NO:182), YALDARG (SEQ ID NO:183), GYAL (SEQ ID NO:184), GYALD (SEQ ID NO:185), GYALDA (SEQ ID NO:186), GYALDAR (SEQ ID NO:187), GYALDARG (SEQ ID NO:188), TGYAL (SEQ ID NO:189), TGYALD (SEQ ID NO:190), TGYALDA (SEQ ID NO:191), TGYALDAR (SEQ ID NO:192), TGYALDARG (SEQ ID NO:193), LTGYAL (SEQ ID NO:194), LTGYALD (SEQ ID NO:195), LTGYALDA (SEQ ID NO:196), LTGYALDAR (SEQ ID NO:197), LTGYALDARG (SEQ ID NO:198). Linear peptides having such sequences may be modified at the N- and/or C-termini, as i the peptides N—Ac-LTGYALDARG-NH$_2$ (SEQ ID NO:199).

A desmoglein-3 CAR sequence may comprise, for example, one or more of the sequences RAL, RALN (SEQ ID NO:151), RALNA (SEQ ID NO:200), RALNAQ (SEQ ID NO:201), RALNAL (SEQ ID NO:202), RALNAQG (SEQ ID NO:203), RALNALG (SEQ ID NO:204), CRAL (SEQ ID NO:157), CRALN (SEQ ID NO:158), CRALNA (SEQ ID NO:205), CRALNAQ (SEQ ID NO:206), CRALNAL (SEQ ID NO:207), CRALNAQG (SEQ ID NO:208), CRALNALG (SEQ ID NO:209), TCRAL (SEQ ID NO:210), TCRALN (SEQ ID NO:211), TCRALNA (SEQ ID NO:212), TCRALNAQ (SEQ ID NO:213), TCRALNAL (SEQ ID NO:214), TCRALNAQG (SEQ ID NO:215), TCRALNALG (SEQ ID NO:216), ITCRAL (SEQ ID NO:217), ITCRALN (SEQ ID NO:218), ITCRALNA (SEQ ID NO:219), ITCRALNAQ (SEQ ID NO:220), ITCRALNAL (SEQ ID NO:221), ITCRALNAQG (SEQ ID NO:222), ITCRALNALG (SEQ ID NO:223). Linear peptides having such sequences may be modified at the N- and/or C-termini, as in the peptides N—Ac-ITCRALNAQG-NH$_2$ (SEQ ID NO:224) and N—Ac-ITCRALNALG-NH$_2$ (SEQ ID NO:225).

A desmocollin-1 CAR sequence may comprise, for example, one or more of the sequences YAT, YATT (SEQ ID NO:226), YATTA (SEQ ID NO:227), YATTAD (SEQ ID NO:228), YATTADG (SEQ ID NO:229), GYAT (SEQ ID NO:230), GYATT (SEQ ID NO:231), GYATTAA (SEQ ID NO:232), GYATTAD (SEQ ID NO:233), GYATTADG (SEQ ID NO:234), AYAT (SEQ ID NO:235), AYATT (SEQ ID NO:236), AYATTA (SEQ ID NO:237), AYATTAD (SEQ ID NO:238), AYATTADG (SEQ ID NO:23 9), YGYAT (SEQ ID NO:240), YGYATTA (SEQ ID NO:241), YGYATTA (SEQ ID NO:242), YGYATTAD (SEQ ID NO:243), YGYATTADG (SEQ ID NO:244), YAYAT (SEQ ID NO:245), YAYATT (SEQ ID NO:246), YAYATTA (SEQ ID NO:247), YAYATTAD (SEQ ID NO:248), YAYATTADG (SEQ ID NO:249), LYGYAT (SEQ ID NO:250), LYGYATT (SEQ ID NO:251), LYGYATTA (SEQ ID NO:252), LYGYATTAD (SEQ ID NO:253), LYGYATTADG (SEQ ID NO:254), LYAYAT (SEQ ID NO:255), LYAYATT (SEQ ID NO:256), LYAYATTA (SEQ ID NO:257), LYAYATTAD (SEQ ID NO:258), LYAYATTADG (SEQ ID NO:259), VYGYAT (SEQ ID NO:260), VYGYATT (SEQ ID NO:261), VYGYATTA (SEQ ID NO:262), VYGYATTAD (SEQ ID NO:263), VYGYATTADG (SEQ ID NO:264), VYAYAT (SEQ ID NO:265), VYAYATT (SEQ ID NO:266), VYAYATTA (SEQ ID NO:267), VYAYATTAD (SEQ ID NO:268), VYAYATTADG (SEQ ID NO:269), IYGYAT (SEQ ID NO:270), IYGYATT (SEQ ID NO:271), IYGYATTA (SEQ ID NO:272), IYGYATTAD (SEQ ID NO:273), IYGYATTADG (SEQ ID NO:274), IYAYAT (SEQ ID NO:275), IYAYATT (SEQ ID NO:276), IYAYATTA (SEQ ID NO:277), IYAYATTAD (SEQ ID NO:278) and IYAYATTADG (SEQ ID NO:279). Linear peptides having such sequences may be modified at the N- and/or C-termini, as in the peptides N—Ac-LYGYATTADG-NH$_2$ (SEQ ID NO:280) N—Ac-LYAYATTADG-NH$_2$ (SEQ ID NO:281) N—Ac-VYGYATTADG-NH$_2$ (SEQ ID NO:282) N—Ac- VYAYATTADG-NH$_2$ (SEQ ID NO:283) N—Ac-IYGYATTADG-NH$_2$ (SEQ ID NO:284) and N—Ac-IYAYATTADG-NH$_2$ (SEQ ID NO:285).

A desmocollin-2 CAR sequence may comprise, for example, one or more of the sequences FAT, FATT (SEQ ID NO:286), FATTP (SEQ ID NO:287), FATTPD (SEQ ID NO:288), FATTPDG (SEQ ID NO:289), AFAT (SEQ ID NO:290), AFATT (SEQ ID NO:291), AFATTP (SEQ ID NO:292), AFATTPD (SEQ ID NO:293), AFATTPDG (SEQ ID NO:294), IAFAT (SEQ ID NO:295), IAFATT (SEQ ID NO:296), IAFATTP (SEQ ID NO:297), IAFATTPD (SEQ ID NO:298), IAFATTPDG (SEQ ID NO:299), IIAFAT (SEQ ID NO:300), IIAFATT (SEQ ID NO:301), IIAFATTP (SEQ ID NO:302), IIAFATTPD (SEQ ID NO:303), IIAFATTPDG (SEQ ID NO:304), IIAFAT (SEQ ID NO:305), IIAFATT (SEQ ID NO:306), LIAFATTP (SEQ ID NO:307), LIAFATTPD (SEQ ID NO:308), LIAFATTPDG (SEQ ID NO:309). Linear peptides having such sequences may be modified at the N- and/or C-termini, as in the peptides N—Ac-IIAFATTPDG—NH$_2$ (SEQ ID NO:310) and N—Ac-LIAFATTPDG-NH$_2$ (SEQ ID NO:311).

A desmocollin-3 or desmocollin4 CAR sequence may comprise, for example, one or more of the sequences YAS, YAST (SEQ ID NO:312), YASTA (SEQ ID NO:313), YASTAD (SEQ ID NO:314), YASTADG (SEQ ID NO:315), AYAS (SEQ ID NO:316), AYAST (SEQ ID NO:317), AYASTA (SEQ ID NO:318), AYASTAD (SEQ ID NO:319), AYASTADG (SEQ ID NO:320), IAYAS (SEQ ID NO:321), IAYAST (SEQ ID NO:322), IAYASTA (SEQ ID NO:323), IAYASTAD (SEQ ID NO:324), IAYASTADG (SEQ ID NO:325), LIAYAS (SEQ ID NO:326), LIAYAST (SEQ ID NO:327), LIAYASTA (SEQ ID NO:328), LIAYASTAD (SEQ ID NO:329), LIAYASTADG (SEQ ID NO:330). Linear peptides having such sequences may be modified at the N- and/or C-termini, as in the peptides N—Ac-LIAYASTADG-NH$_2$ (SEQ ID NO:331).

Those of ordinary skill in the art will recognize that similar peptide sequences may be designed to modulate a function mediated by other cadherins, following identification of a CAR sequence as described herein.

It will be apparent that certain of the peptide sequences provided above may modulate a function mediated by multiple nonclassical cadherins. In general, peptides comprising a greater number of consecutive residues derived from a desmosomal cadherin have a greater specificity for that cadherin. In addition, further flanking sequences may be included to enhance specificity. Such flanking sequences may be identified based on the sequences provided in FIGS. 2 and 3, or based on published sequences. To achieve specificity (I.e., modulation of a desmosomal cadherin function that is enhanced relative to the modulation of a function mediated by a different cadherin), the addition of 2 to 5 flanking residues (preferably at least one residue on either side of the CAR sequence) is generally sufficient.

As noted above, modulating agents provided herein may comprise an analogue or mimetic of a desmosomal cadherin CAR sequence. An analogue generally retains at least 50% identity to a native desmosomal cadherin CAR sequence, and modulates a desmosomal cadherin-mediated function as described herein. Such analogues preferably contain at least three consecutive residues of, and more preferably at least five consecutive residues of, a desmosomal cadherin CAR sequence. An analogue may contain any of a variety of amino acid substitutions, additions, deletions and/or modifications (e.g., side chain modifications). Preferred amino acid substitutions are conservative. A "conservative substitution" is one in which an amino acid is substituted for another amino acid that has similar properties, such that one skilled in the art of peptide chemistry would expect the secondary structure and hydropathic nature of the polypeptide to be substantially unchanged. Amino acid substitutions may generally be made on the basis of similarity in polarity, charge, solubility, hydrophobicity, hydrophilicity and/or the amphipathic nature of the residues. For example, negatively charged amino acids include aspartic acid and glutamic acid; positively charged amino acids include lysine and arginine; and amino acids with uncharged polar head groups having similar hydrophilicity values include leucine, isoleucine and valine; glycine and alanine; asparagine and glutamine; and serine, threonine, phenylalanine and tyrosine. Other groups of amino acids that may represent conservative changes include: (1) ala, pro, gly, glu, asp, gln, asn, ser, thr; (2) cys, ser, tyr, thr; (3) val, ile, leu, met, ala, phe; (4) lys, arg, his; and (5) phe, tyr, trp, his. The critical determining feature of a desmosomal cadherin CAR sequence analogue is the ability to modulate a desmosomal cadherin-mediated function, which may be evaluated using the representative assays provided herein.

A mimetic is a non-peptidyl compound that is conformationally similar to a desmosomal cadherin CAR sequence, such that it modulates a desmosomal cadherin-mediated function as described below. Such mimetics may be designed based on techniques that evaluate the three dimensional structure of the peptide. For example, Nuclear Magnetic Resonance spectroscopy (NMR) and computational techniques may be used to determine the conformation of a desmosomal cadherin CAR sequence. NMR is widely used for structural analyses of both peptidyl and non-peptidyl compounds. Nuclear Overhauser Enhancements (NOE's), coupling constants and chemical shifts depend on the conformation of a compound. NOE data provides the interproton distance between protons through space and can be used to calculate the lowest energy conformation for the desmosomal cadherin CAR sequence. This information can then be used to design mimetics of the preferred conformation. Linear peptides in solution exist in many conformations. By using conformational restriction techniques it is possible to fix the peptide in the active conformation. Conformational restriction can be achieved by i) introduction of an alkyl group such as a methyl which sterically restricts free bond rotation; ii) introduction of unsaturation which fixes the relative positions of the terminal and geminal substituents; and/or iii) cyclization, which fixes the relative positions of the sidechains. Mimetics may be synthesized where one or more of the amide linkages has been replaced by isosteres, substituents or groups which have the same size or volume such as —CH$_2$NH—, —CSNH—, —CH$_2$S—, —CH=CH—, —CH$_2$CH$_2$—, —CONMe- and others. These backbone amide linkages can also be part of a ring structure (e.g., lactam). Mimetics may be designed where one or more of the side chain functionalities of the desmosomal cadherin CAR sequence are replaced by groups that do not necessarily have the same size or volume, but have similar chemical and/or physical properties which produce similar biological responses. Other mimetics may be small molecule mimics, which may be readily identified from small molecule libraries, based on the three-dimensional structure of the CAR sequence. It should be understood that, within embodiments described below, an analogue or mimetic may be substituted for a desmosomal cadherin CAR sequence.

Modulating agents, or peptide portions thereof, may be linear or cyclic peptides. The term "cyclic peptide," as used herein, refers to a peptide or salt thereof that comprises (1)

an intramolecular covalent bond between two non-adjacent residues and (2) at least one desmosomal cadherin CAR sequence or an analogue thereof. The intramolecular bond may be a backbone to backbone, side-chain to backbone or side-chain to side-chain bond (ie., terminal functional groups of a linear peptide and/or side chain functional groups of a terminal or interior residue may be linked to achieve cyclization). Preferred intramolecular bonds include, but are not limited to, disulfide, amide and thioether bonds. One or more of any of the above desmosomal cadherin CAR sequences, or an analogue or mimetic thereof, may be incorporated into a cyclic peptide, with or without one or more other adhesion molecule binding sites. Additional adhesion molecule binding sites are described in greater detail below.

The size of a cyclic peptide ring generally ranges from 5 to about 15 residues, preferably from 5 to 10 residues. Additional residue(s) may be present on the N-terminal and/or C-terminal side of a desmosomal cadherin CAR sequence, and may be derived from sequences that flank a desmosomal cadherin CAR sequence, with or without amino acid substitutions and/or other modifications. Alternatively, additional residues present on one or both sides of the CAR sequence(s) may be unrelated to an endogenous sequence (e.g., residues that facilitate cyclization, purification or other manipulation and/or residues having a targeting or other function).

Within certain embodiments, a modulating agent may comprise a cyclic peptide that contains a desmosomal cadherin CAR sequence as provided in Table I (or a portion of such a CAR sequence). Certain cyclic peptides have the formula:

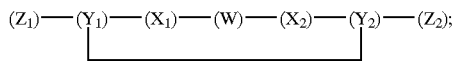

Within this formula, W is a tripeptide selected from the group consisting of NQK, NRN, NKD, EKD, ERD, RAL, YAL, YAT, FAT, and YAS; $X_1$ and $X_2$ are optional, and if present, are independently selected from the group consisting of amino acid residues and combinations thereof in which the residues are linked by peptide bonds, and wherein $X_1$ and $X_2$ independently range in size from 0 to 10 residues, such that the sum of residues contained within $X_1$ and $X_2$ ranges from 1 to 12; $Y_1$ and $Y_2$ are independently selected from the group consisting of amino acid residues, and wherein a covalent bond is formed between residues $Y_1$ and $Y_2$; and $Z_1$ and $Z_2$ are optional, and if present, are independently selected from the group consisting of amino acid residues and combinations thereof in which the residues are linked by peptide bonds.

Cyclic peptides may comprise any of the above CAR sequence(s). Such cyclic peptides may be used as modulating agents without modification, or may be incorporated into a modulating agent.

Representative cyclic peptides comprising a desmoglein CAR sequence include: CNQKC (SEQ ID NO:410), CNQKTC (SEQ ID NO:411), CNQKTGC (SEQ ID NO:412), CINQKC (SEQ ID NO:413), CINQKTC (SEQ ID NO:414), CINQKTGC (SEQ ID NO:415), CVINQKC (SEQ ID NO:416), CVINQKTC (SEQ ID NO:417), CVINQKTGC (SEQ ID NO:418), CFVINQKC (SEQ ID NO:419), CFVINQKTC (SEQ ID NO:420), CFVINQKTGC (SEQ ID NO:421), CIFVINQKC (SEQ ID NO:422), CIFVINQKTC (SEQ ID NO:423), CIFVINQKTGC (SEQ ID NO:424), CNRNC (SEQ ID NO:425), CNRNTC (SEQ ID NO:426), CNRNTGC (SEQ ID NO:427), CINRNC (SEQ ID NO:428), CINRNTC (SEQ ID NO:429), CINRNTGC (SEQ ID NO:430), CIINRNC (SEQ ID NO:431), CIINRNTC (SEQ ID NO:432), CIINRNTGC (SEQ ID NO:433), CFIINRNC (SEQ ID NO:434), CFIINRNTC (SEQ ID NO:435), CFIINRNTGC (SEQ ID NO:436), CMFIINRNC (SEQ ID NO:437), CMFIINRNTC (SEQ ID NO:438), CMFIINRNTGC (SEQ ID NO:439), CNKDC (SEQ ID NO:440), CNKDTC (SEQ ID NO:441), CNKDTGC (SEQ ID NO:442), CLNKDC (SEQ ID NO:443), CLNKDTC (SEQ ID NO:444), CLNKDTGC (SEQ ID NO:445), CYLNKDC (SEQ ID NO:446), CYLNKDTC (SEQ ID NO:447), CYLNKDTGC (SEQ ID NO:448), CFYLNKDC (SEQ ID NO:449), CFYLNKDTC (SEQ ID NO:450), CFYLNKDTGC (SEQ ID NO:451), CVFYLNKDC (SEQ ID NO:452), CVFYLNKDTC (SEQ ID NO:453), CVFYLNKDTGC (SEQ ID NO:454), ENQKK (SEQ ID NO:455), ENQKTK (SEQ ID NO:456), ENQKTGK (SEQ ID NO:457), EINQKK (SEQ ID NO:458), EINQKTK (SEQ ID NO:459), EINQKTGK (SEQ ID NO:460), EVINQKK (SEQ ID NO:461), EVINQKTK (SEQ ID NO:462), EVINQKTGK (SEQ ID NO:463), EFVINQKK (SEQ ID NO:464), EFVINQKTK (SEQ ID NO:465), EFVINQKTGK (SEQ ID NO:466), EIFVINQKK (SEQ ID NO:467), EIFVINQKTK (SEQ ID NO:468), EIFVINQKTGK (SEQ ID NO:469), ENRNK (SEQ ID NO:470), ENRNTK (SEQ ID NO:471), ENRNTGK (SEQ ID NO:472), EINRNK (SEQ ID NO:473), EINRNTK (SEQ ID NO:474), EINRNTGK (SEQ ID NO:475), EIINRNK (SEQ ID NO:476), EIINRNTK (SEQ ID NO:477), EIINRNTGK (SEQ ID NO:478), EFIINRNK (SEQ ID NO:479), EFIINRNTK (SEQ ID NO:480), EFIINRNTGK (SEQ ID NO:481), EMFIINRNK (SEQ ID NO:482), EMFIINRNTK (SEQ ID NO:483), EMFIINRNTGK (SEQ ID NO:484), ENKDK (SEQ ID NO:485), ENKDTK (SEQ ID NO:486), ENKDTGK (SEQ ID NO:487), ELNKDK (SEQ ID NO:488), ELNKDTK (SEQ ID NO:489), ELNKDTGK (SEQ ID NO:490), EYLNKDK (SEQ ID NO:491), EYLNKDTK (SEQ ID NO:492), EYLNKDTGK (SEQ ID NO:493), EFYLNKDK (SEQ ID NO:494), EFYLNKDTK (SEQ ID NO:495), EFYLNKDTGK (SEQ ID NO:496), EVFYLNKDK (SEQ ID NO:497), EVFYLNKDTK (SEQ ID NO:498), EVFYLNKDTGK (SEQ ID NO:499), KNQKD (SEQ ID NO:500), KNQKTD (SEQ ID NO:501), KNQKTGD (SEQ ID NO:502), KINQKD (SEQ ID NO:503), KINQKTD (SEQ ID NO:504), KINQKTGD (SEQ ID NO:505), KVINQKD (SEQ ID NO:506), KVINQKTD (SEQ ID NO:507), KVINQKTGD (SEQ ID NO:508), KFVINQKD (SEQ ID NO:509), KFVINQKTD (SEQ ID NO:510), KFVINQKTGD (SEQ ID NO:511), KIFVINQKD (SEQ ID NO:512), KIFVINQKTD (SEQ ID NO:513), KIFVINQKTGD (SEQ ID NO:514), KNRND (SEQ ID NO:515), KNRNTD (SEQ ID NO:516), KNRNTGD (SEQ ID NO:517), KINRND (SEQ ID NO:518), KINRNTD (SEQ ID NO:519), KINRNTGD (SEQ ID NO:520), KIINRND (SEQ ID NO:521), KIINRNTD (SEQ ID NO:522), KIINRNTGD (SEQ ID NO:523), KFIINRND (SEQ ID NO:524), KFIINRNTD (SEQ ID NO:525), KFIINRNTGD (SEQ ID NO:526), KMFIINRND (SEQ ID NO:527), KMFIINRNTD (SEQ ID NO:528), KMFIINRNTGD (SEQ ID NO:529), KNKDD (SEQ ID NO:530), KNKDTD (SEQ ID NO:531), KNKDTGD (SEQ ID NO:532), KLNKDD (SEQ ID NO:533), KLNKDTD (SEQ ID NO:534) KLNKDTGD (SEQ ID NO:535), KYLNKDD (SEQ ID NO:536), KYLNKDTD (SEQ ID NO:537), KYLNKDTGD (SEQ ID NO:538), KFYLNKDD (SEQ ID NO:539), KFYLNKDTD (SEQ ID NO:540), KFYLNKDTGD (SEQ ID NO:541), KVFYLNKDD (SEQ ID NO:542), KVFYLNKDTD (SEQ ID NO:543), KVFYLNKDTGD (SEQ ID NO:544), DNQKK (SEQ ID NO:545), DNQKTK (SEQ ID NO:546), DNQKTGK (SEQ ID NO:547), DINQKK (SEQ ID NO:548), DINQKTK (SEQ ID NO:549), DINQKTGK (SEQ ID NO:550), DVINQKK (SEQ ID NO:551), DVINQKTK (SEQ ID NO:552), DVINQKTGK (SEQ ID NO:553), DFVINQKK (SEQ ID NO:554), DFVINQKTK (SEQ ID NO:555), DFVINQKTGK (SEQ ID NO:556), DIFVINQKK (SEQ ID NO:557), DIFVINQKTK (SEQ ID NO:558), DIFVINQKTGK (SEQ ID NO:559), DNRNK (SEQ ID NO:560), DNRNTK (SEQ ID NO:561), DNRNTGK (SEQ ID NO:562), DINRNK (SEQ ID NO:563), DINRNTK (SEQ ID NO:564), DINRNTGK (SEQ ID NO:565), DIINRNK (SEQ ID NO:566), DIINRNTK (SEQ ID NO:567), DIINRNTGK (SEQ ID NO:568), DFIINRNK (SEQ ID NO:569), DFIINRNTK (SEQ ID NO:570), DFIINRNTGK (SEQ ID NO:571), DMFIINRNK (SEQ ID NO:572), DMFIINRNTK (SEQ ID NO:573), DMFIINRNTGK (SEQ ID NO:574), DNKDK (SEQ ID NO:575), DNKDTK (SEQ ID NO:576), DNKDTGK (SEQ ID NO:577), DLNKDK (SEQ ID NO:578), DLNKDTK (SEQ ID NO:579), DLNKDTGK (SEQ ID NO:580), DYLNKDK (SEQ ID NO:581), DYLNKDTK (SEQ ID NO:582), DYLNKDTGK (SEQ ID NO:583), DFYLNKDK (SEQ ID NO:584), DFYLNKDTK (SEQ ID NO:585), DFYLNKDTGK (SEQ ID NO:586), DVFYLNKDK (SEQ ID NO:587), DVFYLNKDTK (SEQ ID NO:588), DVFYLNKDTGK (SEQ ID NO:589), KKNQKE (SEQ ID NO:590), KNQKTE (SEQ ID NO:591), KNQKTGE (SEQ ID NO:592), KINQKE (SEQ ID NO:593), KINQKTE (SEQ ID NO:594), KINQKTGE (SEQ ID NO:595), KVINQKE (SEQ ID NO:596), KVINQKTE (SEQ ID NO:597), KVINQKTGE (SEQ ID NO:598), KFVINQKE (SEQ ID NO:599), KFVINQKTE (SEQ ID NO:600), KFVINQKTGE (SEQ ID NO:601), KIFVINQKE (SEQ ID NO:602), KIFVINQKTE (SEQ ID NO:603), KIFVINQKTGE (SEQ ID NO:604), KNRNE (SEQ ID NO:605), KNRNTE (SEQ ID NO:606), KNRNTGE (SEQ ID NO:607), KINRNE (SEQ ID NO:608), KINRNTE (SEQ ID NO:609), KINRNTGE (SEQ ID NO:610), KIINRNE (SEQ ID NO:611), KIINRNTE (SEQ ID NO:612), KIINRNTGE (SEQ ID NO:613), KFIINRNE (SEQ ID NO:614), KFIINRNTE (SEQ ID NO:615), KFUNRNTGE (SEQ ID NO:616), KMFIINRNE (SEQ ID NO:617), KMFINRNTE (SEQ ID NO:618), KMFINRNTGE (SEQ ID NO:619), KNKDE (SEQ ID NO:620), KNKDTE (SEQ ID NO:621), KNKDTGE (SEQ ID NO:622), KLNKDE (SEQ ID NO:623), KLNKDTE (SEQ ID NO:624), KLNKDTGE (SEQ ID NO:625), KYLNKDE (SEQ ID NO:626), KYLNKDTE (SEQ ID NO:627), KYLNKDTGE (SEQ ID NO:628), KFYLNKDE (SEQ ID NO:629), KFYLNKDTE (SEQ ID NO:630), KFYLNKDTGE (SEQ ID NO:631), KVFYLNKDE (SEQ ID NO:632), KVFYLNKDTE (SEQ ID NO:633), KVFYLNKDTGE (SEQ ID NO:634), NQKTG (SEQ ID NO:635), INQKT (SEQ ID NO:636), INQKTG (SEQ ID NO:637), VINQK (SEQ ID NO:638), VINQKT (SEQ ID NO:639), VINQKTG (SEQ ID NO:640), FVINQK (SEQ ID NO:641), FVINQKT (SEQ ID NO:642), FVINQKTG (SEQ ID NO:643), IFVINQK (SEQ ID NO:644), IFVINQKT (SEQ ID NO:645), IFVINQKTG (SEQ ID NO:646), NRNTG (SEQ ID NO:647), INRNT (SEQ ID NO:648), INRNTG (SEQ ID NO:649), IINRN (SEQ ID NO:650), IINRNT (SEQ ID NO:651), IINRNTG (SEQ ID NO:652), FIINRN (SEQ ID NO:653), FIINRNT (SEQ ID NO:654), FIINRNTG (SEQ ID NO:655), MFIINRN (SEQ ID NO:656), MFIINRNT (SEQ ID NO:657), MFIINRNTG (SEQ ID NO:658), NKDTG (SEQ ID NO:659), LNKDT (SEQ ID NO:660), LNKDTG (SEQ ID NO:661), YLNKD (SEQ ID NO:662), YLNKDT (SEQ ID NO:663), YLNKDTG (SEQ ID NO:664), FYLNKD (SEQ ID NO:665), FYLNKDT (SEQ ID NO:666), FYLNKDTG (SEQ ID NO:667), VFYLNKD (SEQ ID NO:668), VFYLNKDT (SEQ ID NO:669) and VFYLNKDTG (SEQ ID NO:670).

Representative cyclic peptides comprising a desmocollin CAR sequence include: CEKDC (SEQ ID NO:671), CEKDTC (SEQ ID NO:672), CEKDTGC (SEQ ID NO:673), CIEKDC (SEQ ID NO:674), CIEKDTC (SEQ ID NO:675), CIEKDTGC (SEQ ID NO:676), CYIEKDC (SEQ ID NO:677), CYIEKDTC (SEQ ID NO:678), CYIEKDTGC (SEQ ID NO:679), CFYIEKDC (SEQ ID NO:680), CFYIEKDTC (SEQ ID NO:681), CFYIEKDTGC (SEQ ID NO:682), CLFYIEKDC (SEQ ID NO:683), CLFYIEKDTC (SEQ ID NO:684), CLFYIEKDTGC (SEQ ID NO:685), CERDC (SEQ ID NO:686), CERDTC (SEQ ID NO:687), CERDTGC (SEQ ID NO:688), CVERDC (SEQ ID NO:689), CVERDTC (SEQ ID NO:690), CVERDTGC (SEQ ID NO:691), CYVERDC (SEQ ID NO:692), CYVERDTC (SEQ ID NO:693), CYVERDTGC (SEQ ID NO:694), CFYVERDC (SEQ ID NO:695), CFYVERDTC (SEQ ID NO:696), CFYVERDTGC (SEQ ID NO:697), CLFYVERDC (SEQ ID NO:698), CLFYVERDTC (SEQ ID NO:699), CLFYVERDTGC (SEQ ID NO:700), CIERDC (SEQ ID NO:701), CIERDTC (SEQ ID NO:702), CIERDTGC (SEQ ID NO:703), CYIERDC (SEQ ID NO:704), CYIERDTC (SEQ ID NO:705), CYIERDTGC (SEQ ID NO:706), CFYIERDC (SEQ ID NO:707), CFYIERDTC (SEQ ID NO:708), CFYIERDTGC (SEQ ID NO:709), CLFYIERDC (SEQ ID NO:710), CLFYIERDTC (SEQ ID NO:711), CLFYIERDTGC (SEQ ID NO:712), EEKDK (SEQ ID NO:713), EEKDTK (SEQ ID NO:714), EEKDTGK (SEQ ID NO:715), EIEKDK (SEQ ID NO:716), EIEKDTK (SEQ ID NO:717), EIEKDTGK (SEQ ID NO:718), EYIEKDK (SEQ ID NO:719), EYIEKDTK (SEQ ID NO:720), EYIEKDTGK (SEQ ID NO:721), EFYIEKDK (SEQ ID NO:722), EFYIEKDTK (SEQ ID NO:723), EFYIEKDTGK (SEQ ID NO:724), ELFYIEKDK (SEQ ID NO:725), ELFYIEKDTK (SEQ ID NO:726), ELFYIEKDTGK (SEQ ID NO:727), EERDK (SEQ ID NO:728), EERDTK (SEQ ID NO:729), EERDTGK (SEQ ID NO:730), EVERDK (SEQ ID NO:731), EVERDTK (SEQ ID NO:732), EVERDTGK (SEQ ID NO:733), EYVERDK (SEQ ID NO:734), YVERDTK (SEQ ID NO:735), EYVERDTGK (SEQ ID NO:736), EFYVERDK (SEQ ID NO:737), EFYVERDTK (SEQ ID NO:738), EFYVERDTGK (SEQ ID NO:739), ELFYVERDK (SEQ ID NO:740), ELFYVERDTK (SEQ ID NO:741), ELFYVERDTGK (SEQ ID NO:742), EIERDK (SEQ ID NO:743), EIERDTK (SEQ ID NO:744), EIERDTGK (SEQ ID NO:745), EYIERDK (SEQ ID NO:746), EYIERDTK (SEQ ID NO:747), EYIERDTGK (SEQ ID NO:748), EFYIERDK (SEQ ID NO:749), EFYIERDTK (SEQ ID NO:750), EFYIERDTGK (SEQ ID NO:751), ELFYIERDK (SEQ ID NO:752), ELFYIERDTK (SEQ ID NO:753), ELFYIERDTGK (SEQ ID NO:754), KEKDD (SEQ ID NO:755), KEKDTD (SEQ ID NO:756), KEKDTGD (SEQ ID NO:757), KIEKDD (SEQ ID NO:758), KIEKDTD (SEQ ID NO:759), KIEKDTGD (SEQ ID NO:760), KYIEKDD (SEQ ID NO:761), KYIEKDTD (SEQ ID NO:762), KYIEKDTGD (SEQ ID NO:763), KFYIEKDD (SEQ ID NO:764), KFYIEKDTD (SEQ ID NO:765), KFYIEKDTGD (SEQ ID NO:766), KLFYIEKDD (SEQ ID NO:767), KLFYIEKDTD (SEQ ID NO:768), KLFYIEKDTGD (SEQ ID NO:769), KERDD (SEQ ID NO:770), KERDTD (SEQ ID NO:771), KERDTGD (SEQ ID NO:772), KVERDD (SEQ ID NO:773), KVERDTD (SEQ ID NO:774), KVERDTGD (SEQ ID NO:775), KYVERDD (SEQ ID NO:776), KYVERDTD (SEQ ID NO:777), KYVERDTGD (SEQ ID NO:778), KFYVERDD (SEQ ID NO:779), KFYVERDTD (SEQ ID NO:780), KFYVERDTGD (SEQ ID NO:781), KLFYVERDD (SEQ ID NO:782), KLFYVERDTD (SEQ ID NO:783), KLFYVERDTGD (SEQ ID NO:784), KIERDD (SEQ ID NO:785), KIERDTD (SEQ ID NO:786), KIERDTGD (SEQ ID NO:787), KYIERD (SEQ ID NO:788), KYERDTD (SEQ ID NO:789), KYIERDTGD (SEQ ID NO:790), KFYERDD (SEQ ID NO:791), KFYERDTD (SEQ ID NO:792), KFYIERDTGD (SEQ ID NO:793), KLFYIERDD (SEQ ID NO:794), KLFYIERDTD (SEQ ID NO:795), KLFYIERDTGD (SEQ ID NO:796), DEKDK (SEQ ID NO:797), DEKDTK (SEQ ID NO:798), DEKDTGK (SEQ ID NO:799), DIEKDK (SEQ ID NO:800), DIEKDTK (SEQ ID NO:801), DIEKDTGK (SEQ ID NO:802), DYIEKDK (SEQ ID NO:803), DYIEKDTK (SEQ ID NO:804), DYIEKDTGK (SEQ ID NO:805), DFYEKDK (SEQ ID NO:806), DFYEKDTK (SEQ ID NO:807), DFYIEKDTGK (SEQ ID NO:808), DLFYEKDK (SEQ ID NO:809), DLFYIEKDTK (SEQ ID NO:810), DLFYIEKDTGK (SEQ ID NO:811), DERDK (SEQ ID NO:812), DERDTK (SEQ ID NO:813), DERDTGK (SEQ ID NO:814), DVERDK (SEQ ID NO:815), DVERDTK (SEQ ID NO:816), DVERDTGK (SEQ ID NO:817), DYVERDK (SEQ ID NO:818), DYVERDTK (SEQ ID NO:819), DYVERDTGK (SEQ ID NO:820), DFYVERDK (SEQ ID NO:821), DFYVERDTK (SEQ ID NO:822), DFYVERDTGK (SEQ ID NO:823), DLFYVERDK (SEQ ID NO:824), DLFYVERDTK (SEQ ID NO:825), DLFYVERDTGK (SEQ ID NO:826), DIERDK (SEQ ID NO:827), DIERDTK (SEQ ID NO:828), DIERDTGK (SEQ ID NO:829), DYIERDK (SEQ ID NO:830), DYIERDTK (SEQ ID NO:831), DYIERDTGK (SEQ ID NO:832), DFYIERDK (SEQ ID NO:833), DFYIERDTK (SEQ ID NO:834), DFYIERDTGK (SEQ ID NO:835), DLFYIERDK (SEQ ID NO:836), DLFYERDTK (SEQ ID NO:837), DLFYIERDTGK (SEQ ID NO:838), KEKDE (SEQ ID NO:839), KEKDTE (SEQ ID NO:840), KEKDTGE (SEQ ID NO:841), KEKDE (SEQ ID NO:842), KIEKDTE (SEQ ID NO:843), KIEKDTGE (SEQ ID NO:844), KYIEKDE (SEQ ID NO:845), KYIEKDTE (SEQ ID NO:846), KYIEKDTGE (SEQ ID NO:847), KFYIEKDE (SEQ ID NO:848), KFYIEKDTE (SEQ ID NO:849), KFYEKDTGE (SEQ ID NO:850), KLFYIEKDE (SEQ ID NO:851), KLFYIEKDTE (SEQ ID NO:852), KLFYEKDTGE (SEQ ID NO:853), KERDE (SEQ ID NO:854), KERDTE (SEQ ID NO:855), KERDTGE (SEQ ID NO:856), KVERDE (SEQ ID NO:857), KVERDTE (SEQ ID NO:858), KVERDTGE (SEQ ID NO:859), KYVERDE (SEQ ID NO:860), KYVERDTE (SEQ ID NO:861), KYVERDTGE (SEQ ID NO:862), KFYVERDE (SEQ ID NO:863), KFYVERDTE (SEQ ID NO:864), KEYVERDTGE (SEQ ID NO:865), KLFYVERDE (SEQ ID NO:866), KLFYVERDTE (SEQ ID NO:867), KLFYVERDTGE (SEQ ID NO:868), KIERDE (SEQ ID NO:869), KIERDTE (SEQ ID NO:870), KIERDTGE (SEQ ID NO:871), KYIERDE (SEQ ID NO:872), KYIERDTE (SEQ ID NO:873), KYIERDTGE (SEQ ID NO:874), KFYIERDE (SEQ ID NO:875), KFYIERDTE (SEQ ID NO:876), KFYIERDTGE (SEQ ID NO:877), KLFYIERDE (SEQ ID NO:878), KLFYIERDTE (SEQ ID NO:879), KLFYIERDTGE (SEQ ID NO:880), EKDTG (SEQ ID NO:881), IEKDT (SEQ ID NO:882), IEKDTG (SEQ ID NO:883), YIEKD (SEQ ID NO:884), YIEKDT (SEQ ID NO:885), YIEKDTG (SEQ ID NO:886), FYIEKD (SEQ ID NO:887), FYIEKDT (SEQ ID NO:888), FYIEKDTG (SEQ ID NO:889), LFYIEKD (SEQ ID NO:890), LFYIEKDT (SEQ ID NO:891), LFYIEKDTG (SEQ ID NO:892), ERDTG (SEQ ID NO:893), VERDT (SEQ ID NO:894), VERDTG (SEQ ID NO:895), YVERD (SEQ ID NO:896), YVERDT (SEQ ID NO:897), YVERDTG (SEQ ID NO:898), FYVERD (SEQ ID NO:899), FYVERDT (SEQ ID NO:900), FYVERDTG (SEQ ID NO:901), LFYVERD (SEQ ID NO:902), LFYVERDT (SEQ ID NO:903), LFYVERDTG (SEQ ID NO:904), IERDT (SEQ ID NO:905), IERDTG (SEQ ID NO:906), YIERD (SEQ ID NO:907), YIERDT (SEQ ID NO:908), YIERDTG (SEQ ID NO:909), FYIERD (SEQ ID NO:910), FYIERDT (SEQ ID NO:911), FYIERDTG (SEQ ID NO:912), LFYIERD (SEQ ID NO:913), LFYIERDT (SEQ ID NO:914) and LFYIERDTG (SEQ ID NO:915).

Representative cyclic peptides comprising a desmoglein-1 CAR sequence include: CRALC (SEQ ID NO:916), CRALNC (SEQ ID NO:917), CRALNSC (SEQ ID NO:918), CRALNSMC (SEQ ID NO:919), CRALNSLC (SEQ ID NO:920), CRALNSMGC (SEQ ID NO:921), CRALNSLGC (SEQ ID NO:922), CCRALC (SEQ ID NO:923), CCRALNC (SEQ ID NO:924), CCRALNSC (SEQ ID NO:925), CCRALNSMC (SEQ ID NO:926), CCRALNSLC (SEQ ID NO:927), CCRALNSMGC (SEQ ID NO:928), CCRALNSLGC (SEQ ID NO:929), CYCRALC (SEQ ID NO:930), CYCRALNC (SEQ ID NO:931), CYCRALNSC (SEQ ID NO:932), CYCRALNSMC (SEQ ID NO:933), CYCRALNSLC (SEQ ID NO:934), CYCRALNSMGC (SEQ ID NO:935), CYCRALNSLGC (SEQ ID NO:936), CIYRALC (SEQ ID NO:937), CIYRALNC (SEQ ID NO:938), CIYRALNSC (SEQ ID NO:939), CIYRALNSMC (SEQ ID NO:940), CIYRALNSLC (SEQ ID NO:941), CIYRALNSMGC (SEQ ID NO:942), CIYRALNSLGC (SEQ ID NO:943), ERALK (SEQ ID NO:944), ERALNK (SEQ ID NO:945), ERALNSK (SEQ ID NO:946), ERALNSMK (SEQ ID NO:947), ERALNSLK (SEQ ID NO:948), ERALNSMGK (SEQ ID NO:949), ERALNSLGK (SEQ ID NO:950), ECRALK (SEQ ID NO:951), ECRALNK (SEQ ID NO:952), ECRALNSK (SEQ ID NO:953), ECRALNSMK (SEQ ID NO:954), ECRALNSLK (SEQ ID NO:955), ECRALNSMGK (SEQ ID NO:956), ECRALNSLGK (SEQ ID NO:957), EYCRALK (SEQ ID NO:958), EYCRALNK (SEQ ID NO:959), EYCRALNSK (SEQ ID NO:960), EYCRALNSMK (SEQ ID NO:961), EYCRALNSLK (SEQ ID NO:962), EYCRALNSMGK (SEQ ID NO:963), EYCRALNSLGK (SEQ ID NO:964), EIYRALK (SEQ ID NO:965), EIYRALNK (SEQ ID NO:966), EIYRALNSK (SEQ ID NO:967), EIYRALNSMK (SEQ ID NO:968), EIYRALNSLK (SEQ ID NO:969), EIYRALNSMGK (SEQ ID NO:970), EIYRALNSLGK (SEQ ID NO:971), KRALE (SEQ ID NO:972), KRALNE (SEQ ID NO:973), KRALNSE (SEQ ID NO:974), KRALNSME (SEQ ID NO:975), KRALNSLE (SEQ ID NO:976), KRALNSMGE (SEQ ID NO:977), KRALNSLGE (SEQ ID NO:978), KCRALE (SEQ ID NO:979), KCRALNE (SEQ ID NO:980), KCRALNSE (SEQ ID NO:981), KCRALNSME (SEQ ID NO:982), KCRALNSLE (SEQ ID NO:983), KCRALNSMGE (SEQ ID NO:984), KCRALNSLGE (SEQ ID NO:985), KYCRALE (SEQ ID NO:986), KYCRALNE (SEQ ID NO:987), KYCRALNSE (SEQ ID NO:988), KYCRALNSME (SEQ ID NO:989), KYCRALNSLE (SEQ ID NO:990), KYCRALNSMGE (SEQ ID NO:991), KYCRALNSLGE (SEQ ID NO:992), KIYRALE (SEQ ID NO:993), KIYRALNE (SEQ ID NO:994), KIYRALNSE (SEQ ID NO:995), KIYRALNSME (SEQ ID NO:996), KIYRALNSLE (SEQ ID NO:997), KIYRALNSMGE (SEQ ID NO:998), KIYRALNSLGE (SEQ ID NO:999), DRALK (SEQ ID NO:1000), DRALNK (SEQ ID NO:1001), DRALNSK (SEQ ID NO:1002), DRALNSMK (SEQ ID NO:1003), DRALNSLK (SEQ ID NO:1004), DRALNSMGK (SEQ ID NO:1005), DRALNSLGK (SEQ ID NO:1006), DCRALK (SEQ ID NO:1007), DCRALNK (SEQ ID NO:1008), DCRALNSK (SEQ ID NO:1009), DCRALNSMK (SEQ ID NO:1010), DCRALNSLK (SEQ ID NO:1011), DCRALNSMGK (SEQ ID NO:1012), DCRALNSLGK (SEQ ID NO:1013), DYCRALK (SEQ ID NO:1014), DYCRALNK (SEQ ID NO:1015), DYCRALNSK (SEQ ID NO:1016), DYCRALNSMK (SEQ ID NO:1017), DYCRALNSLK (SEQ ID NO:1018), DYCRALNSMGK (SEQ ID NO:1019), DYCRALNSLGK (SEQ ID NO:1020), DIYRALK (SEQ ID NO:1021), DIYRALNK (SEQ ID NO:1022), DIYRALNSK (SEQ ID NO:1023), DIYRANSMK (SEQ ID NO:1024), DIYRALNSLK (SEQ ID NO:1025), DIYRALNSMGK (SEQ ID NO:1026), DIYRALNSLGK (SEQ ID NO:1027), KRALD (SEQ ID NO:1028), KRALND (SEQ ID NO:1029), KRALNSD (SEQ ID NO:1030), KRALNSMD (SEQ ID NO:1031), KRALNSLD (SEQ ID NO:1032), KRALNSMGD (SEQ ID NO:1033), KRALNSLGD (SEQ ID NO:1034), KCRALD (SEQ ID NO:1035), KCRALND (SEQ ID NO:1036), KCRALNSD (SEQ ID NO:1037), KCRALNSMD (SEQ ID NO:1038), KCRALNSLD (SEQ ID NO:1039), KCRALNSMGD (SEQ ID NO:1040), KCRALNSLGD (SEQ ID NO:1041), KYCRALD (SEQ ID NO:1042), KYCRALND (SEQ ID NO:1043), KYCRALNSD (SEQ ID NO:1044), KYCRALNSMD (SEQ ID NO:1045), KYCRALNSLD (SEQ ID NO:1046), KYCRALNSMGD (SEQ ID NO:1047), KYCRALNSLGD (SEQ ID NO:1048), KIYRALD (SEQ ID NO:1049), KIYRALND (SEQ ID NO:1050), KIYRALNSD (SEQ ID NO:1051), KIYRALNSMD (SEQ ID NO:1052), KIYRALNSLD (SEQ ID NO:1053), KIYRANSMGD (SEQ ID NO:1054), KIYRALNSLGD (SEQ ID NO:1055), RALNS (SEQ ID NO:1056), RALNSM (SEQ ID NO:1057), RALNSL (SEQ ID NO:1058), RALNSMG (SEQ ID NO:1059), RALNSLG (SEQ ID NO:1060), CRALN (SEQ ID NO:1061), CRALNS (SEQ ID NO:1062), CRALNSM (SEQ ID NO:1063), CRALNSL (SEQ ID NO:1064), CRALNSMG (SEQ ID NO:1065), CRALNSLG (SEQ ID NO:1066), YCRAL (SEQ ID NO:1067), YCRALN (SEQ ID NO:1068), YCRALNS (SEQ ID NO:1069), YCRALNSM (SEQ ID NO:1070), YCRALNSL (SEQ ID NO:1071), YCRALNSMG (SEQ ID NO:1072), YCRALNSLG (SEQ ID NO:1073), IYRAL (SEQ ID NO:1074), IYRALN (SEQ ID NO:1075), IYRALNS (SEQ ID NO:1076), IYRALNSM (SEQ ID NO:1077), IYRALNSL (SEQ ID NO:1078), IYRALNSMG (SEQ ID NO:1079) and IYRALNSLG (SEQ ID NO:1080).

Representative cyclic peptides comprising a desmoglein-2 CAR sequence include:. CYALC (SEQ ID NO:1081), CYALDC (SEQ ID NO:1082), CYALDAC (SEQ ID NO:1083), CYALDARC (SEQ ID NO:1084), CYALDARGC (SEQ ID NO:1085), CGYALC (SEQ ID NO:1086), CGYALDC (SEQ ID NO:1087), CGYALDAC (SEQ ID NO:1088), CGYALDARC (SEQ ID NO:1089), CGYALDARGC (SEQ ID NO:1090), CTGYALC (SEQ ID NO:1091), CTGYALDC (SEQ ID NO:1092), CTGYALDAC (SEQ ID NO:1093), CTGYALDARC (SEQ ID NO:1094), CTGYALDARGC (SEQ ID NO:1095), CLTGYALC (SEQ ID NO:1096), CLTGYALDC (SEQ ID NO:1097), CLTGYALDAC (SEQ ID NO:1098), CLTGYALDARC (SEQ ID NO:1099), CLTGYALDARGC (SEQ ID NO:1100), EYALK (SEQ ID NO:1101), EYALDK (SEQ ID NO:1102), EYALDAK (SEQ ID NO:1103), EYALDARK (SEQ ID NO:1104), EYALDARGK (SEQ ID NO:1105), EGYALK (SEQ ID NO:1106), EGYALDK (SEQ ID NO:1107), EGYALDAK (SEQ ID NO:1108), EGYALDARK (SEQ ID NO:1109), EGYALDARGK (SEQ ID NO:1110), ETGYALK (SEQ ID NO:1111), ETGYALDK (SEQ ID NO:1112), ETGYALDAK (SEQ ID NO:1113), ETGYALDARK (SEQ ID NO:1114), ETGYALDARGK (SEQ ID NO:1115), ELTGYALK (SEQ ID NO:1116), ELTGYALDK (SEQ ID NO:1117), ELTGYALDAK (SEQ ID NO:1118), ELTGYALDARK (SEQ ID NO:1119), ELTGYALDARGK (SEQ ID NO:1120), KYALE (SEQ ID NO:1121), KYALDE (SEQ ID NO:1122), KYALDAE (SEQ ID NO:1123), KYALDARE (SEQ ID NO:1124), KYALDARGE (SEQ ID NO:1125), KGYALE (SEQ ID NO:1126), KGYALDE (SEQ ID NO:1127), KGYALDAE (SEQ ID NO:1128), KGYALDARE (SEQ ID NO:1129), KGYALDARGE (SEQ ID NO:1130), KTGYALE (SEQ ID NO:1131), KTGYALDE (SEQ ID NO:1132), KTGYALDAE (SEQ ID NO:1133), KTGYALDARE (SEQ ID NO:1134), KTGYALDARGE (SEQ ID NO:1135), KLTGYALE (SEQ ID NO:1136), KLTGYALDE (SEQ ID NO:1137), KLTGYALDAE (SEQ ID NO:1138), KLTGYALDARE (SEQ ID NO:1139), KLTGYALDARGE (SEQ ID NO:1140), DYALK (SEQ ID NO:1141), DYALDK (SEQ ID NO:1142), DYALDAK (SEQ ID NO:1143), DYALDARK (SEQ ID NO:1144), DYALDARGK (SEQ ID NO:1145), DGYALK (SEQ ID NO:1146), DGYALDK (SEQ ID NO:1147), DGYALDAK (SEQ ID NO:1148), DGYALDARK (SEQ ID NO:1149), DGYALDARGK (SEQ ID NO:1150), DTGYALK (SEQ ID NO:1151), DTGYALDK (SEQ ID NO:1152), DTGYALDAK (SEQ ID NO:1153), DTGYALDARK (SEQ ID NO:1154), DTGYALDARGK (SEQ ID NO:1155), DLTGYALK (SEQ ID NO:1156), DLTGYALDK (SEQ ID NO:1157), DLTGYALDAK (SEQ ID NO:1158), DLTGYALDARK (SEQ ID NO:1159), DLTGYALDARGK (SEQ ID NO:1160), KYALD (SEQ ID NO:1161), KYALDD (SEQ ID NO:1162), KYALDAD (SEQ ID NO:1163), KYALDARD (SEQ ID NO:1164), KYALDARGD (SEQ ID NO:1165), KGYALD (SEQ ID NO:1166), KGYALDD (SEQ ID NO:1167), KGYALDAD (SEQ ID NO:1168), KGYALDARD (SEQ ID NO:1169), KGYALDARGD (SEQ ID NO:1170), KTGYALD (SEQ ID NO:1171), KTGYALDD (SEQ ID NO:1172), KTGYALDAD (SEQ ID NO:1173), KTGYALDARD (SEQ ID NO:1174), KTGYALDARGD (SEQ ID NO:1175), KLTGYALD (SEQ ID NO:1176), KLTGYALDD (SEQ ID NO:1177), KLTGYALDAD (SEQ ID NO:1178), KLTGYALDARD (SEQ ID NO:1179), KLTGYALDARGD (SEQ ID NO:1180), YALDA (SEQ ID NO:1181), YALDAR (SEQ ID NO:1182), YALDARG (SEQ ID NO:1183), GYALD (SEQ ID NO:1184), GYALDA (SEQ ID NO:1185), GYALDAR (SEQ ID NO:1186), GYALDARG (SEQ ID NO:1187), TGYAL (SEQ ID NO:1188), TGYALD (SEQ ID NO:1189), TGYALDA (SEQ ID NO:1190), TGYALDAR (SEQ ID NO:1191), TGYALDARG (SEQ ID NO:1192), LTGYAL (SEQ ID NO:1193), LTGYALD (SEQ ID NO:1194), LTGYALDA (SEQ ID NO:1195), LTGYALDAR (SEQ ID NO:1196) and LTGYALDARG (SEQ ID NO:1197).

Representative cyclic peptides comprising a desmoglein-3 CAR sequence include: CRALC (SEQ ID NO:916), CRALNC (SEQ ID NO:917), CRALNAC (SEQ ID NO:1198), CRALNAQC (SEQ ID NO:1199), CRALNALC (SEQ ID NO:1200), CRALNAQGC (SEQ ID NO:1201), CRALNALGC (SEQ ID NO:1202), CCRALC (SEQ ID NO:923), CCRALNC (SEQ ID NO:924), CCRALNAC (SEQ ID NO:1203), CCRALNAQC (SEQ ID NO:1204), CCRALNALC (SEQ ID NO:1205), CCRALNAQGC (SEQ ID NO:1206), CCRALNALGC (SEQ ID NO:1207), CTCRALC (SEQ ID NO:1208), CTCRALNC (SEQ ID NO:1209), CTCRALNAC (SEQ ID NO:1210), CTCRALNAQC (SEQ ID NO:1211), CTCRALNALC (SEQ ID NO:1212), CTCRALNAQGC (SEQ ID NO:1213), CTCRALNALGC (SEQ ID NO:1214), CITCRALC (SEQ ID NO:1215), CITCRALNC (SEQ ID NO:1216), CITCRALNAC (SEQ ID NO:1217), CITCRALNAQC (SEQ ID NO:1218), CITCRALNALC (SEQ ID NO:1219), CITCRALNAQGC (SEQ ID NO:1220), CITCRALNALGC (SEQ ID NO:1221), ERALK (SEQ ID NO:944), ERALNK (SEQ ID NO:945), ERALNAK (SEQ ID NO:1222), ERALNAQK (SEQ ID NO:1223), ERALNALK (SEQ ID NO:1224), ERALNAQGK (SEQ ID NO:1225), ERALNALGK (SEQ ID NO:1226), ECRALK (SEQ ID NO:951), ECRALNK (SEQ ID NO:952), ECRALNAK (SEQ ID NO:1227), ECRALNAQK (SEQ ID NO:1228), ECRALNALK (SEQ ID NO:1229), ECRALNAQGK (SEQ ID NO:1230), ECRALNALGK (SEQ ID NO:1231), ETCRALK (SEQ ID NO:1232), ETCRALNK (SEQ ID NO:1233), ETCRALNAK (SEQ ID NO:1234), ETCRALNAQK (SEQ ID NO:1235), ETCRALNALK (SEQ ID NO:1236), ETCRALNAQGK (SEQ ID NO:1237), ETCRALNALGK (SEQ ID NO:1238), EITCRALK (SEQ ID NO:1239), EITCRALNK (SEQ ID NO:1240), EITCRALNAK (SEQ ID NO:1241), EITCRALNAQK (SEQ ID NO:1242), EITCRALNALK (SEQ ID NO:1243), EITCRALNAQGK (SEQ ID NO:1244), EITCRALNALGK (SEQ ID NO:1245), KRALE (SEQ ID NO:972), KRALNE (SEQ ID NO:973), KRALNAE (SEQ ID NO:1246), KRALNAQE (SEQ ID NO:1247), KRALNALE (SEQ ID NO:1248), KRALNAQGE (SEQ ID NO:1249), KRALNALGE (SEQ ID NO:1250), KCRALE (SEQ ID NO:979), KCRALNE (SEQ ID NO:980), KCRALNAE (SEQ ID NO:1251), KCRALNAQE (SEQ ID NO:1252), KCRALNALE (SEQ ID NO:1253), KCRALNAQE (SEQ ID NO:1254), KCRALNALGE (SEQ ID NO:1255), KTCRALE (SEQ ID NO:1256), KTCRALNE (SEQ ID NO:1257), KTCRALNAE (SEQ ID NO:1258), KTCRALNAQE (SEQ ID NO:1259), KTCRALNALE (SEQ ID NO:1260), KTCRALNAQGE (SEQ ID NO:1261), KTCRALNALGE (SEQ ID NO:1262), KITCRALE (SEQ ID NO:1263), KITCRALNE (SEQ ID NO:1264), KITCRALNAE (SEQ ID NO:1265), KITCRALNAQE (SEQ ID NO:1266), KITCRALNALE (SEQ ID NO:1267), KITCRALNAQGE (SEQ ID NO:1268), KITCRALNALGE (SEQ ID NO:1269), DRALK (SEQ ID NO:1000), DRALNK (SEQ ID NO:1001), DRALNAK (SEQ ID NO:1270), DRALNAQK (SEQ ID NO:1271), DRALNALK (SEQ ID NO:1272), DRALNAQGK (SEQ ID NO:1273), DRALNALGK (SEQ ID NO:1274), DCRALK (SEQ ID NO:1007), DCRALNK (SEQ ID NO:1008), DCRALNAK (SEQ ID NO:1275), DCRALNAQK (SEQ ID NO:1276), DCRALNALK (SEQ ID NO:1277), DCRALNAQGK (SEQ ID NO:1278), DCRALNALGK (SEQ ID NO:1279), DTCRALK (SEQ ID NO:1280), DTCRALNK (SEQ ID NO:1281), DTCRALNAK (SEQ ID NO:1282), DTCRALNAQK (SEQ ID NO:1283), DTCRALNALK (SEQ ID NO:1284), DTCRALNAQGK (SEQ ID NO:1285), DTCRALNALGK (SEQ ID NO:1286), DITCRALK (SEQ ID NO:1287), DITCRALNK (SEQ ID NO:1288), DITCRALNAK (SEQ ID NO:1289), DITCRALNAQK (SEQ ID NO:1290), DITCRALNALK (SEQ ID NO:1291), DITCRALNAQGK (SEQ ID NO:1292), DITCRALNALGK (SEQ ID NO:1293), KRALD (SEQ ID NO:1028), KRALND (SEQ ID NO:1029), KRALNAD (SEQ ID NO:1294), KRALNAQD (SEQ ID NO:1295), KRALNALD (SEQ ID NO:1296), KRALNAQGD (SEQ ID NO:1297), KRALNALGD (SEQ ID NO:1298), KCRALD (SEQ ID NO:1034), KCRALND (SEQ ID NO:1035), KCRALNAD (SEQ ID NO:1299), KCRALNAQD (SEQ ID NO:1300), KCRALNALD (SEQ ID NO:1301), KCRALNAQGD (SEQ ID NO:1302), KCRALNALGD (SEQ ID NO:1303), KTCRALD (SEQ ID NO:1304), KTCRALND (SEQ ID NO:1305), KTCRALNAD (SEQ ID NO:1306), KTCRALNAQD (SEQ ID NO:1307), KTCRALNALD (SEQ ID NO:1308), KTCRALNAQGD (SEQ ID NO:1309), KTCRALNALGD (SEQ ID NO:1310), KITCRALD (SEQ ID NO:1311), KITCRALND (SEQ ID NO:1312), KITCRALNAD (SEQ ID NO:1313), KITCRALNAQD (SEQ ID NO:1314), KITCRALNALD (SEQ ID NO:1315), KITCRALNAQGD (SEQ ID NO:1316), KITCRALNALGD (SEQ ID NO:1317), RALNA (SEQ ID NO:1318), RALNAQ (SEQ ID NO:1319), RALNAL (SEQ ID NO:1320), RALNAQG (SEQ ID NO:1321), RALNALG (SEQ ID NO:1322), CRALN (SEQ ID NO:1323), CRALNA (SEQ ID NO:1324), CRALNAQ (SEQ ID NO:1325), CRALNAL (SEQ ID NO:1326), CRALNAQG (SEQ ID NO:1327), CRALNALG (SEQ ID NO:1328), TCRAL (SEQ ID NO:1329), TCRALN (SEQ ID NO:1330), TCRALNA (SEQ ID NO:1331), TCRALNAQ (SEQ ID NO:1332), TCRALNAL (SEQ ID NO:1333), TCRALNAQG (SEQ ID NO:1334), TCRALNALG (SEQ ID NO:1335), ITCRAL (SEQ ID NO:1336), ITCRALN (SEQ ID NO:1337), ITCRALNA (SEQ ID NO:1338), ITCRALNAQ (SEQ ID NO:1339), ITCRALNAL (SEQ ID NO:1340), ITCRALNAQG (SEQ ID NO:1341) and ITCRALNALG (SEQ ID NO:1342).

Representative cyclic peptides comprising a desmocollin-1 CAR sequence include: CYATC (SEQ ID NO:1343), CYATTC (SEQ ID NO:1344), CYATTAC (SEQ ID NO:1345), CYATTADC (SEQ ID NO:1346), CYATTADGC (SEQ ID NO:1347), CGYATC (SEQ ID NO:1348), CGYATTC (SEQ ID NO:1349), CGYATTAC (SEQ ID NO:1350), CGYATTADC (SEQ ID NO:1351), CGYATTADGC (SEQ ID NO:1352), CAYATC (SEQ ID NO:1353), CAYATTC (SEQ ID NO:1354), CAYATTAC (SEQ ID NO:1355), CAYATTADC (SEQ ID NO:1356), CAYATTADGC (SEQ ID NO:1357), CYGYATC (SEQ ID NO:1358), CYGYATTC (SEQ ID NO:1359), CYGYATTAC (SEQ ID NO:1360), CYGYATTADC (SEQ ID NO:1361), CYGYATTADGC (SEQ ID NO:1362), CYAYATC (SEQ ID NO:1363), CYAYATTC (SEQ ID NO:1364), CYAYATTAC (SEQ ID NO:1365), CYAYATTADC (SEQ ID NO:1366), CYAYATTADGC (SEQ ID NO:1367), CLYGYATC (SEQ ID NO:1368), CLYGYATTC (SEQ ID NO:1369), CLYGYATTAC (SEQ ID NO:1370), CLYGYATTADC (SEQ ID NO:1371), CLYGYATTADGC (SEQ ID NO:1372), CLYAYATC (SEQ ID NO:1373), CLYAYATTC (SEQ ID NO:1374), CLYAYATTAC (SEQ ID NO:1375), CLYAYATTADC (SEQ ID NO:1376), CLYAYATTADGC (SEQ ID NO:1377), CVYGYATC (SEQ ID NO:1378), CVYGYATTC (SEQ ID NO:1379), CVYGYATTAC (SEQ ID NO:1380), CVYGYATTADC (SEQ ID NO:1381), CVYGYATTADGC (SEQ ID NO:1382), CVYAYATC (SEQ ID NO:1383), CVYAYATTC (SEQ ID NO:1384), CVYAYATTAC (SEQ ID NO:1385), CVYAYATTADC (SEQ ID NO:1386), CVYAYATTADGC (SEQ ID NO:1387), CIYGYATC (SEQ ID NO:1388), CIYGYATTC (SEQ ID NO:1389), CIYGYATTAC (SEQ ID NO:1390), CIYGYATTADC (SEQ ID NO:1391), CIYGYATTADGC (SEQ ID NO:1392), CIYAYATC (SEQ ID NO:1393), CIYAYATTC (SEQ ID NO:1394), CIYAYATTAC (SEQ ID NO:1395), CIYAYATTADC (SEQ ID NO:1396), CIYAYATTADGC (SEQ ID NO:1397), EYATK (SEQ ID NO:1398), EYATTK (SEQ ID NO:1399), EYATTAK (SEQ ID NO:1400), EYATTADK (SEQ ID NO:1401), EYATTADGK (SEQ ID NO:1402), EGYATK (SEQ ID NO:1403), EGYATTK (SEQ ID NO:1404), EGYATTAK (SEQ ID NO:1405), EGYATTADK (SEQ ID NO:1406), EGYATTADGK (SEQ ID NO:1407), EAYATK (SEQ ID NO:1408), EAYATTK (SEQ ID NO:1409), EAYATTAK (SEQ ID NO:1410), EAYATTADK (SEQ ID NO:1411), EAYATTADGK (SEQ ID NO:1412), EYGYATK (SEQ ID NO:1413), EYGYATTK (SEQ ID NO:1414), EYGYATTAK (SEQ ID NO:1415), EYGYATTADK (SEQ ID NO:1416), EYGYATTADGK (SEQ ID NO:1417), EYAYATK (SEQ ID NO:1418), EYAYATTK (SEQ ID NO:1419), EYAYATTAK (SEQ ID NO:1420), EYAYATTADK (SEQ ID NO:1421), EYAYATTADGK (SEQ ID NO:1422), ELYGYATK (SEQ ID NO:1423), ELYGYATTK (SEQ ID NO:1424), ELYGYATTAK (SEQ ID NO:1425), ELYGYATTADK (SEQ ID NO:1426), ELYGYATTADGK (SEQ ID NO:1427), ELYAYATK (SEQ ID NO:1428), ELYAYATTK (SEQ ID NO:1429), ELYAYATTAK (SEQ ID NO:1430), ELYAYATTADK (SEQ ID NO:1431), ELYAYATTADGK (SEQ ID NO:1432), EVYGYATK (SEQ ID NO:1433), EVYGYATTK (SEQ ID NO:1434), EVYGYATTAK (SEQ ID NO:1435), EVYGYATTADK (SEQ ID NO:1436), EVYGYATTADGK (SEQ ID NO:1437), EVYAYATK (SEQ ID NO:1438), EVYAYATTK (SEQ ID NO:1439), EVYAYATTAK (SEQ ID NO:1440), EVYAYATTADK (SEQ ID NO:1441), EVYAYATTADGK (SEQ ID NO:1442), EIYGYATK (SEQ ID NO:1443), EIYGYATTK (SEQ ID NO:1444), EIYGYATTAK (SEQ ID NO:1445), EIYGYATTADK (SEQ ID NO:1446), EIYGYATTADGK (SEQ ID NO:1447), EIYAYATK (SEQ ID NO:1448), EIYAYATTK (SEQ ID NO:1449), EIYAYATTAK (SEQ ID NO:1450), EIYAYATTADK (SEQ ID NO:1451), EIYAYATTADGK (SEQ ID NO:1452), KYATE (SEQ ID NO:1453), KYATTE (SEQ ID NO:1454), KYATTAE (SEQ ID NO:1455), KYATTADE (SEQ ID NO:1456), KYATTADGE (SEQ ID NO:1457), KGYATE (SEQ ID NO:1458), KGYATTE (SEQ ID NO:1459), KGYATTAE (SEQ ID NO:1460), KGYATTADE (SEQ ID NO:1461), KGYATTADGE (SEQ ID NO:1462), KAYATE (SEQ ID NO:1463), KAYATTE (SEQ ID NO:1464), KAYATTAE (SEQ ID NO:1465), KAYATTADE (SEQ ID NO:1466), KAYATTADGE (SEQ ID NO:1467), KYGYATE (SEQ ID NO:1468), KYGYATM (SEQ ID NO:1469), KYGYATTAE (SEQ ID NO:1470), KYGYATTADE (SEQ ID NO:1471), KYGYATTADGE (SEQ ID NO:1472), KYAYATE (SEQ ID NO:1473), KYAYATTE (SEQ ID NO:1474), KYAYATTAE (SEQ ID NO:1475), KYAYATTADE (SEQ ID NO:1476), KYAYATTADGE (SEQ ID NO:1477), KLYGYATE (SEQ ID NO:1478), KLYGYATTE (SEQ ID NO:1479), KLYGYATTAE (SEQ ID NO:1480), KLYGYATTADE (SEQ ID NO:1481), KLYGYATTADGE (SEQ ID NO:1482), KLYAYATE (SEQ ID NO:1483), KLYAYATTE (SEQ ID NO:1484), KLYAYATTAE (SEQ ID NO:1485), KLYAYATTADE (SEQ ID NO:1486), KLYAYATTADGE (SEQ ID NO:1487), KVYGYATE (SEQ ID NO:1488), KVYGYATTE (SEQ ID NO:1489), KVYGYATTAE (SEQ ID NO:1490), KVYGYATTADE (SEQ ID NO:1491), KVYGYATTADGE (SEQ ID NO:1492), KVYAYATE (SEQ ID NO:1493), KVYAYATT (SEQ ID NO:1494), KVYAYATTAE (SEQ ID NO:1495), KVYAYATTADE (SEQ ID NO:1496), KVYAYATTADGE (SEQ ID NO:1497), KIYGYATE (SEQ ID NO:1498), KIYGYATTE (SEQ ID NO:1499), KIYGYATTAE (SEQ ID NO:1500), KIYGYATTADE (SEQ ID NO:1501), KIYGYATTADGE (SEQ ID NO:1502), KIYAYATE (SEQ ID NO:1503), KIYAYATM (SEQ ID NO:1504), KIYAYATTAE (SEQ ID NO:1505), KIYAYATTADE (SEQ ID NO:1506), KIYAYATTADGE (SEQ ID NO:1507), DYATK (SEQ ID NO:1508), DYATTK (SEQ ID NO:1509), DYATTAK (SEQ ID NO:1510), DYATTADK (SEQ ID NO:1511), DYATTADGK (SEQ ID NO:1512), DGYATK (SEQ ID NO:1513), DGYATTK (SEQ ID NO:1514), DGYATTAK (SEQ ID NO:1515), DGYATTADK (SEQ ID NO:1516), DGYATTADGK (SEQ ID NO:1517), DAYATK (SEQ ID NO:1518), DAYATTK (SEQ ID NO:1519), DAYATTAK (SEQ ID NO:1520), DAYATTADK (SEQ ID NO:1521), DAYATTADGK (SEQ ID NO:1522), DYGYATK (SEQ ID NO:1523), DYGYATTK (SEQ ID NO:1524), DYGYATTAK (SEQ ID NO:1525), DYGYATTADK (SEQ ID NO:1526), DYGYATTADGK (SEQ ID NO:1527), DYAYATK (SEQ ID NO:1528), DYAYATTK (SEQ ID NO:1529), DYAYATTAK (SEQ ID NO:1530), DYAYATTADK (SEQ ID NO:1531), DYAYATTADGK (SEQ ID NO:1532), DLYGYATK (SEQ ID NO:1533), DLYGYATTK (SEQ ID NO:1534), DLYGYATTAK (SEQ ID NO:1535), DLYGYATTADK (SEQ ID NO:1536), DLYGYATTADGK (SEQ ID NO:1537), DLYAYATK (SEQ ID NO:1538), DLYAYATTK (SEQ ID NO:1539), DLYAYATTAK (SEQ ID NO:1540), DLYAYATTADK (SEQ ID NO:1541), DLYAYATTADGK (SEQ ID NO:1542), DVYGYATK (SEQ ID NO:1543), DVYGYATTK (SEQ ID NO:1544), DVYGYATTAK (SEQ ID NO:1545), DVYGYATTADK (SEQ ID NO:1546), DVYGYATTADGK (SEQ ID NO:1547), DVYAYATK (SEQ ID NO:1548), DVYAYATTK (SEQ ID NO:1549), DVYAYATTAK (SEQ ID NO:1550), DVYAYATTADK (SEQ ID NO:1551), DVYAYATTADGK (SEQ ID NO:1552), DIYGYATK (SEQ ID NO:1553), DIYGYATTK (SEQ ID NO:1554), DIYGYATTAK (SEQ ID NO:1555), DIYGYATTADK (SEQ ID NO:1556), DIYGYATTADGK (SEQ ID NO:1557), DIYAYATK (SEQ ID NO:1558), DIYAYATTK (SEQ ID NO:1559), DIYAYATTAK (SEQ ID NO:1560), DIYAYATTADK (SEQ ID NO:1561), DIYAYATTADGK (SEQ ID NO:1562), KYATD (SEQ ID NO:1563), KYATTD (SEQ ID NO:1564), KYATTAD (SEQ ID NO:1565), KYATTADD (SEQ ID NO:1566), KYATTADGD (SEQ ID NO:1567), KGYATD (SEQ ID NO:1568), KGYATTD (SEQ ID NO:1569), KGYATTAD (SEQ ID NO:1570), KGYATTADD (SEQ ID NO:1571), KGYATTADGD (SEQ ID NO:1572), KAYATD (SEQ ID NO:1573), KAYATTD (SEQ ID NO:1574), KAYATTAD (SEQ ID NO:1575), KAYATTADD (SEQ ID NO:1576), KAYATTADGD (SEQ ID NO:1577), KYGYATD (SEQ ID NO:1578), KYGYATTD (SEQ ID NO:1579), KYGYATTAD (SEQ ID NO:1580), KYGYATTADD (SEQ ID NO:1581), KYGYATTADGD (SEQ ID NO:1582), KYAYATD (SEQ ID NO:1583), KYAYATTD (SEQ ID NO:1584), KYAYATTAD (SEQ ID NO:1585), KYAYATTADD (SEQ ID NO:1586), KYAYATTADGD (SEQ ID NO:1587), KLYGYATD (SEQ ID NO:1588), KLYGYATTD (SEQ ID NO:1589), KLYGYATTAD (SEQ ID NO:1590), KLYGYATTADD (SEQ ID NO:1591), KLYGYATTADGD (SEQ ID NO:1592), KLYAYATD (SEQ ID NO:1593), KLYAYATTD (SEQ ID NO:1594), KLYAYATTAD (SEQ ID NO:1595), KLYAYATTADD (SEQ ID NO:1596), KLYAYATTADGD (SEQ ID NO:1597), KVYGYATD (SEQ ID NO:1598), KVYGYATTD (SEQ ID NO:1599), KVYGYATTAD (SEQ ID NO:1600), KVYGYATTADD (SEQ ID NO:1601), KVYGYATTADGD (SEQ ID NO:1602), KVYAYATD (SEQ ID NO:1603), KVYAYATTD (SEQ ID NO:1604), KVYAYATTAD (SEQ ID NO:1605), KVYAYATTADD (SEQ ID NO:1606), KVYAYATTADGD (SEQ ID NO:1607), KIYGYATD (SEQ ID NO:1608), KIYGYATTD (SEQ ID NO:1609), KIYGYATTD (SEQ ID NO:1610), KIYGYATTADD (SEQ ID NO:1611), KIYGYATTADGD (SEQ ID NO:1612), KIYAYATD (SEQ ID NO:1613), KIYAYATTD (SEQ ID NO:1614), KIYAYATTAD (SEQ ID NO:1615), KIYAYATTADD (SEQ ID NO:1616), KIYAYATTADGD (SEQ ID NO:1617), YATTA (SEQ ID NO:1618), YATTAD (SEQ ID NO:1619), YATTADG (SEQ ID NO:1620), GYATT (SEQ ID NO:1621), GYATTA (SEQ ID NO:1622), GYATTAD (SEQ ID NO:1623), GYATTADG (SEQ ID NO:1624), AYATT (SEQ ID NO:1625), AYATTA (SEQ ID NO:1626), AYATTAD (SEQ ID NO:1627), AYATTADG (SEQ ID NO:1628), YGYAT (SEQ ID NO:1629), YGYATT (SEQ ID NO:1630), YGYATTA (SEQ ID NO:1631), YGYATTAD (SEQ ID NO:1632), YGYATTADG (SEQ ID NO:1633), YAYAT (SEQ ID NO:1634), YAYATT (SEQ ID NO:1635), YAYATTA (SEQ ID NO:1636), YAYATTAD (SEQ ID NO:1637), YAYATTADG (SEQ ID NO:1638), LYGYAT (SEQ ID NO:1639), LYGYATT (SEQ ID NO:1640), LYGYATTA (SEQ ID NO:1641), LYGYATTAD (SEQ ID NO:1642), LYGYATTADG (SEQ ID NO:1643), LYAYAT (SEQ ID NO:1644), LYAYATT (SEQ ID NO:1645), LYAYATTA (SEQ ID NO:1646), LYAYATTAD (SEQ ID NO:1647), LYAYATTADG (SEQ ID NO:1648), VGYAT (SEQ ID NO:1649), VYGYATT (SEQ ID NO:1650), VYGYATTA (SEQ ID NO:1651), VYGYATTAD (SEQ ID NO:1652), VYGYATTADG (SEQ ID NO:1653), VYAYAT (SEQ ID NO:1654), VYAYATT (SEQ ID NO:1655), VYAYATTA (SEQ ID NO:1656), VYAYATTAD (SEQ ID NO:1657), VYAYATTADG (SEQ ID NO:1658), IYGYAT (SEQ ID NO:1659), IYGYATT (SEQ ID NO:1660), IYGYATTA (SEQ ID NO:1661), IYGYATTAD (SEQ ID NO:1662), IYGYATTADG (SEQ ID NO:1663), IYAYAT (SEQ ID NO:1664), IYAYATT (SEQ ID NO:1665), IYAYATTA (SEQ ID NO:1666), IYAYATTAD (SEQ ID NO:1667) and IYAYATTADG (SEQ ID NO:1668).

Representative cyclic peptides comprising a desmocollin-2 CAR sequence include: CFATC (SEQ ID NO:1669), CFATTC (SEQ ID NO:1670), CFATTPC (SEQ ID NO:1671), CFATTPDC (SEQ ID NO:1672), CFATTPDGC (SEQ ID NO:1673), CAFATC (SEQ ID NO:1674), CAFATTC (SEQ ID NO:1675), CAFATTPC (SEQ ID NO:1676), CAFATTPDC (SEQ ID NO:1677), CAFATTPDGC (SEQ ID NO:1678), CIAFATC (SEQ ID NO:1679), CIAFATTC CIAFATTPC (SEQ ID NO:1681), CIAFATTPDC (SEQ ID NO:1682), CIAFATTDGC (SEQ ID NO:1683), CIIAFATC (SEQ ID NO:1684), CIIAFATTC (SEQ ID NO:1685), CIIAFATTPC (SEQ ID NO:1686), CIIAFATTPDC (SEQ ID NO:1687), CIAFATTPDGC (SEQ ID NO:1688), CLIAFATC (SEQ ID NO:1689), CLIAFATTC (SEQ ID NO:1690), CLIAFATTPC (SEQ ID NO:1691), CLIAFATTPDC (SEQ ID NO:1692), CLIAFATTPDGC (SEQ ID NO:1693), EFATK (SEQ ID NO:1694), EFATTK (SEQ ID NO:1695), EFATTPK (SEQ ID NO:1696), EFATTPDK (SEQ ID NO:1697), EFATTPDGK (SEQ ID NO:1698), EAFATK (SEQ ID NO:1699), EAFATTK (SEQ ID NO:1700), EAFATTPK (SEQ ID NO:1701), EAFATTPDK (SEQ ID NO:1702), EAFATTPDGK (SEQ ID NO:1703), EIAFATK (SEQ ID NO:1704), EIAFATTK (SEQ ID NO:1705), EIAFATTPK (SEQ ID NO:1706), EIAFATTPDK (SEQ ID NO:1707), EIAFATTPDGK (SEQ ID NO:1708), EIIAFATK (SEQ ID NO:1709), EIIAFATTK (SEQ ID NO:1710), EIIAFATTPK (SEQ ID NO:1711), EIIAFATTPDK (SEQ ID NO:1712), EIIAFATTPDGK (SEQ ID NO:1713), ELIAFATK (SEQ ID NO:1714), ELIAFATTK (SEQ ID NO:1715), ELIAFATTPK (SEQ ID NO:1716), ELIAFATTPDK (SEQ ID NO:1717), ELIAFATTPDGK (SEQ ID NO:1718), KFATE (SEQ ID NO:1719), KFATTE (SEQ ID NO:1720), KFATTPE (SEQ ID NO:1721), KFATTPDE (SEQ ID NO:1722), KFATTPDGE (SEQ ID NO:1723), KAFATE (SEQ ID NO:1724), KAFATTE (SEQ ID NO:1725), KAFATTPE (SEQ ID NO:1726), KAFATTPDE (SEQ ID NO:1727), KAFATTPDGE (SEQ ID NO:1728), KIAFATE (SEQ ID NO:1729), KIAFATTE (SEQ ID NO:1730), KIAFATTPE (SEQ ID NO:1731), KIAFATTPDE (SEQ ID NO:1732), KIAFATTPDGE (SEQ ID NO:1733), KIIAFATE (SEQ ID NO:1734), KIIAFATTE (SEQ ID NO:1735), KIIAFATTPE (SEQ ID NO:1736), KILAFATTPDE (SEQ ID NO:1737), KIIAFATTPDGE (SEQ ID NO:1738), KLIAFATE (SEQ ID NO:1739), KLIAFATUE (SEQ ID NO:1740), KLIAFATTPE (SEQ ID NO:1741), KLIAFATTPDE (SEQ ID NO:1742), KLIAFATTPDGE (SEQ ID NO:1743), DFATK (SEQ ID NO:1744), DFATTK (SEQ ID NO:1745), DFATTPK (SEQ ID NO:1746), DFATTPDK (SEQ ID NO:1747), DFATTPDGK (SEQ ID NO:1748), DAFATK (SEQ ID NO:1749), DAFATTK (SEQ ID NO:1750), DAFATTPK (SEQ ID NO:1751), DAFATTPDK (SEQ ID NO:1752), DAFATTPDGK (SEQ ID NO:1753), DIAFATK (SEQ ID NO:1754), DIAFATTK (SEQ ID NO:1755), DIAFATTPK (SEQ ID NO:1756), DIAFATTPDK (SEQ ID NO:1757), DIAFATTPDGK (SEQ ID NO:1758), DIIAFATK (SEQ ID NO:1759), DIIAFATTK (SEQ ID NO:1760), DIIAFATTPK (SEQ ID NO:1761), DIIAFATTPDK (SEQ ID NO:1762), DIIAFATTPDGK (SEQ ID NO:1763), DLIAFATK (SEQ ID NO:1764), DLIAFATTK (SEQ ID NO:1765), DLIAFATTPK (SEQ ID NO:1766), DLIAFATTPDK (SEQ ID NO:1767), DLIAFATTPDGK (SEQ ID NO:1768), KFATD (SEQ ID NO:1769), KFATTD (SEQ ID NO:1770), KFATTPD (SEQ ID NO:1771), KFATTPDD (SEQ ID NO:1772), KFATTPDGD (SEQ ID NO:1773), KAFATD (SEQ ID NO:1774), KAFATTD (SEQ ID NO:1775), KAFATTPD (SEQ ID NO:1776), KAFATTPDD (SEQ ID NO:1777), KAFATTPDGD (SEQ ID NO:1778), KIAFATD (SEQ ID NO:1779), KIAFATTD (SEQ ID NO:1780), KIAFATTPD (SEQ ID NO:1781), KIAFATTPDD (SEQ ID NO:1782), KIAFATPDGD (SEQ ID NO:1783), KIIAFATD (SEQ ID NO:1784), KIIAFATTD (SEQ ID NO:1785), KIIAFATTPD (SEQ ID NO:1786), KIIAFATTPDD (SEQ ID NO:1787), KIIAFATTPDGD (SEQ ID NO:1788), KLIAFATD (SEQ ID NO:1789), KLIAFATTD (SEQ ID NO:1790), KLIAFATTPD (SEQ ID NO:1791), KLIAFATTPDD (SEQ ID NO:1792), KLIAFATTPDGD (SEQ ID NO:1793), FATTP (SEQ ID NO:1794), FATTPD (SEQ ID NO:1795), FATTPDG (SEQ ID NO:1796), AFATT (SEQ ID NO:1797), AFATT (SEQ ID NO:1798), AFATTPD (SEQ ID NO:1799), AFATTPDG (SEQ ID NO:1800), IAFAT (SEQ ID NO:1801), IAFATT (SEQ ID NO:1802), IAFATTP (SEQ ID NO:1803), IAFATTPD (SEQ ID NO:1804), IAFATTPDG (SEQ ID NO:1805), IIAFAT (SEQ ID NO:1806), IIAFATT (SEQ ID NO:1807), IIAFATTP (SEQ ID NO:1808), IIAFATTPD (SEQ ID NO:1809), IIAFATTPDG (SEQ ID NO:1810), LIAFAT (SEQ ID NO:1811), LIAFATT (SEQ ID NO:1812), LIAFATTP (SEQ ID NO:1813), LIAFATTPD (SEQ ID NO:1814), LIAFATTPDG (SEQ ID NO:1815).

Representative cyclic peptides comprising a desmocollin-3 or desmocollin-4 CAR sequence include: CYASC (SEQ ID NO:1816), CYASTC (SEQ ID NO:1817), CYASTAC (SEQ ID NO:1818), CYASTADC (SEQ ID NO:1819), CYASTADGC (SEQ ID NO:1820), CAYASC (SEQ ID NO:1821), CAYASTC (SEQ ID NO:1822), CAYASTAC (SEQ ID NO:1823), CAYASTADC (SEQ ID NO:1824), CAYASTADGC (SEQ ID NO:1825), CIAYASC (SEQ ID NO:1826), CIAYASTC (SEQ ID NO:1827), CIAYASTAC (SEQ ID NO:1828), CIAYASTADC (SEQ ID NO:1829), CIAYASTADGC (SEQ ID NO:1830), CLIAYASC (SEQ ID NO:1831), CLIAYASTC (SEQ ID NO:1832), CLIAYASTAC (SEQ ID NO:1833), CLIAYASTADC (SEQ ID NO:1834), CLIAYASTADGC (SEQ ID NO:1835), EYASK (SEQ ID NO:1836), EYASTK (SEQ ID NO:1837), EYASTAK (SEQ ID NO:1838), EYASTADK (SEQ ID NO:1839), EYASTADGK (SEQ ID NO:1840), EAYASK (SEQ ID NO:1841), EAYASTK (SEQ ID NO:1842), EAYASTAK (SEQ ID NO:1843), EAYASTADK (SEQ ID NO:1844), EAYASTADGK (SEQ ID NO:1845), EIAYASK (SEQ ID NO:1846), EIAYASTK (SEQ ID NO:1847), EIAYASTAK (SEQ ID NO:1848), EIAYASTADK (SEQ ID NO:1849), EIAYASTADGK (SEQ ID NO:1850), ELIAYASK (SEQ ID NO:1851), ELIAYASTK (SEQ ID NO:1852), ELIAYASTAK (SEQ ID NO:1853), ELIAYASTADK (SEQ ID NO:1854), ELIAYASTADGK (SEQ ID NO:1855), KYASE (SEQ ID NO:1856), KYASTE (SEQ ID NO:1857), KYASTAE (SEQ ID NO:1858), KYASTADE (SEQ ID NO:1859), KYASTADGE (SEQ ID NO:1860), KAYASE (SEQ ID NO:1861), KAYASTE (SEQ ID NO:1862), KAYASTAE (SEQ ID NO:1863), KAYASTADE (SEQ ID NO:1864), KAYASTADGE (SEQ ID NO:1865), KIAYASE (SEQ ID NO:1866), KIAYASTE (SEQ ID NO:1867), KIAYASTAE (SEQ ID NO:1868), KIAYASTADE (SEQ ID NO:1869), KIAYASTADGE (SEQ ID NO:1870), KLIAYASE (SEQ ID NO:1871), KLIAYASTE (SEQ ID NO:1872), KLIAYASTAE (SEQ ID NO:1873), KLIAYASTADE (SEQ ID NO:1874), KLIAYASTADGE (SEQ ID NO:1875), DYASK (SEQ ID NO:1876), DYASTK (SEQ ID NO:1877), DYASTAK (SEQ ID NO:1878), DYASTADK (SEQ ID NO:1879), DYASTADGK (SEQ ID NO:1880), DAYASK (SEQ ID NO:1881), DAYASTK (SEQ ID NO:1882), DAYASTAK (SEQ ID NO:1883), DAYASTADK (SEQ ID NO:1884), DAYASTADGK (SEQ ID NO:1885), DIAYASK (SEQ ID NO:1886), DIAYASTK (SEQ ID NO:1887), DIAYASTAK (SEQ ID NO:1888), DIAYASTADK (SEQ ID NO:1889), DIAYASTADGK (SEQ ID NO:1890), DLIAYASK (SEQ ID NO:1891), DLIAYASTK (SEQ ID NO:1892), DLIAYASTAK (SEQ ID NO:1893), DLIAYASTADK (SEQ ID NO:1894), DLIAYASTADGK (SEQ ID NO:1895), KYASD (SEQ ID NO:1896), KYASTD (SEQ ID NO:1897), KYASTAD (SEQ ID NO:1898), KYASTADD (SEQ ID NO:1899), KYASTADGD (SEQ ID NO:1900), KAYASD (SEQ ID NO:1901), KAYASTD (SEQ ID NO:1902), KAYASTAD (SEQ ID NO:1903), KAYASTADD (SEQ ID NO:1904), KAYASTADGD (SEQ ID NO:1905), KIAYASD (SEQ ID NO:1906), KIAYASTD (SEQ ID NO:1907), KIAYASTAD (SEQ ID NO:1908), KIAYASTADD (SEQ ID NO:1909), KIAYASTADGD (SEQ ID NO:1910), KLIAYASD (SEQ ID NO:1911), KLIAYASTD (SEQ ID NO:1912), KLIAYASTAD (SEQ ID NO:1913), KLIAYASTADD (SEQ ID NO:1914), KLIAYASTADGD (SEQ ID NO:1915), YASTA (SEQ ID NO:1916), YASTAD (SEQ ID NO:1917), YASTADG (SEQ ID NO:1918), AYAST (SEQ ID NO:1919), AYASTA (SEQ ID NO:1920), AYASTAD (SEQ ID NO:1921), AYASTADG (SEQ ID NO:1922), IAYAS (SEQ ID NO:1923), IAYAST (SEQ ID NO:1924), IAYASTA (SEQ ID NO:1925), IAYASTAD (SEQ ID NO:1926), IAYASTADG (SEQ ID NO:1927), LIAYAS (SEQ ID NO:1928), LIAYAST (SEQ ID NO:1929), LIAYASTA (SEQ ID NO:1930), LIAYASTAD (SEQ ID NO:1931) and LIAYASTADG (SEQ ID NO:1932).

As noted above, certain preferred modulating agents comprise a peptide (containing a desmosomal cadherin CAR sequence or an analogue thereof) in which at least one terminal amino acid residue is modified (e.g., the N-terminal amino group is modified by, for example, acetylation or alkoxybenzylation and/or an amide or ester is formed at the C-terminus). It has been found, within the context of the present invention, that the addition of at least one such group to a linear or cyclic peptide modulating agent may improve the ability of the agent to modulate a desmosomal cadherin-mediated function. Certain preferred modulating agents contain modifications at the N- and C-terminal residues, such as N-terminal acetylation and/or C-terminal amidation.

The present invention further contemplates desmosomal cadherin CAR sequences from other organisms. Such CAR sequences may be identified based upon similarity to the sequences provided herein, and the ability to modulate a desmosomal cadherin-mediated function such as may be confirmed as described herein.

Within certain embodiments, as discussed below, cyclic peptides that contain small CAR sequences (e.g., three residues without significant flanking sequences) are preferred for modulating desmosomal cadherin-mediated functions. Such peptides may contain an N-acetyl group and a C-amide group. Small cyclic peptides may generally be used to specifically modulate adhesion of cancer and/or other cell types by topical administration or by systemic administration, with or without linking a targeting agent to the peptide, as discussed below.

Within embodiments in which inhibition of a desmosomal cadherin-interaction is desired, a modulating agent may contain one desmosomal cadherin CAR sequence, or multiple CAR sequences that are adjacent to one another (i.e., without intervening sequences) or in close proximity (ie., separated by peptide and/or non-peptide linkers to give a distance between the desmosomal CAR sequences that ranges from about 0.1 to 400 nm). A linker may be any molecule (including peptide and/or non-peptide sequences) that does not contain a CAR sequence and that can be covalently linked to at least two peptide sequences. Using a linker, CAR sequence-containing peptides and other peptide or protein sequences may be joined end-to-end (ie., the linker may be covalently attached to the carboxyl or amino group of each peptide sequence), and/or via side chains. One linker that can be used for such purposes is $(H_2N(CH_2)_nCO_2H)$, or derivatives thereof, where n ranges from 1 to 4. Other linkers that may be used will be apparent to those of ordinary skill in the art. Peptide and non-peptide linkers may generally be incorporated into a modulating agent using any appropriate method known in the art.

Within embodiments in which enhancement of cell adhesion mediated by a desmosomal cadherin is desired, a modulating agent may contain multiple desmosomal cadherin CAR sequences, or antibodies that specifically bind to such sequences, joined by linkers as described above. For enhancers of cadherin function, the linker distance should generally be 400–10,000 nm. One linker that can be used for such purposes is $(H_2N(CH_2)_nCO_2H)_m$, or derivatives thereof, where n ranges from 1 to and m ranges from 1 to 4000. For example, if glycine ($H_2NCH_2CO_2H$) or a multimer thereof is used as a linker, each glycine unit corresponds to a linking distance of 2.45 angstroms, or 0.245 nm, as determined by calculation of its lowest energy conformation when linked to other amino acids using molecular modeling techniques. Similarly, aminopropanoic acid corresponds to a linking distance of 3.73 angstroms, aminobutanoic acid to 4.96 angstroms, aminopentanoic acid to 6.30 angstroms and amino hexanoic acid to 6.12 angstroms. Enhancement of cell adhesion may also be achieved by attachment of multiple modulating agents to a support material, as discussed further below.

Certain preferred modulating agents may comprise a desmoglein CAR sequence in combination with a desmocollin CAR sequence. When the CAR sequences are joined by linkers as described above, such agents may be used, for example, to promote cell adhesion in a variety of contexts. By way of example, such an agent could comprise the dsg-2 CAR sequence YAL in combination with the dsc-2 CAR sequence FAT.

A modulating agent as described herein may additionally comprise one or more CAR sequences for one or more different adhesion molecules (including, but not limited to, nonclassical cadherins and other CAMs) and/or one or more substances, such as antibodies or fragments thereof, that bind to such sequences. Linkers may, but need not, be used to separate such CAR sequence(s) and/or antibody sequence (s) from the CAR sequence(s) and/or each other. Such modulating agents may generally be used within methods in which it is desirable to simultaneously disrupt a function mediated by multiple adhesion molecules. As used herein, an "adhesion molecule" is any molecule that mediates cell adhesion via a receptor on a cell's surface. Adhesion molecules include cell adhesion proteins (e.g., other members of the cadherin gene superfamily, such as N-cadherin and E-cadherin); integrins; extracellular matrix proteins such as laminin, fibronectin, collagens, vitronectin, entactin and tenascin; and members of the immunoglobulin supergene family, such as N-CAM. Preferred CAR sequences for inclusion within a modulating agent include the classical cadherin CAR sequence His-Ala-Val (HAV); Arg-Gly-Asp (RGD), which is bound by integrins (see Cardarelli et al., *J. Biol Chem.* 267:23159–64, 1992); Tyr-Ile-Gly-Ser-Arg (YIGSR; SEQ ID NO:1933), which is bound by $\alpha6\beta1$ integrin; KYSFNYDGSE (SEQ ID NO:1934), which is bound by N-CAM; the N-CAM heparin sulfate-binding site IWKHKGRDVILKKDVRF (SEQ ID NO:1935); the putative claudin CAR sequence IYSY (SEQ ID NO:1936) and/or the occludin CAR sequence LYHY (SEQ ID NO:1937.

Other preferred CAR sequences for inclusion within a modulating agent include OB-cadherin CAR sequences such as DDK, IDDK (SEQ ID NO:1938) DDKS (SEQ ID NO:1939) VIDDK (SEQ ID NO:1940), IDDKS (SEQ ID NO:1941), VIDDKS (SEQ ID NO:1942), DDKSG (SEQ ID NO:1943), IDDKSG (SEQ ID NO:1944), VIDDKSG (SEQ ID NO:1945), FVIDDK (SEQ ID NO:1946), FVIDDKS (SEQ ID NO:1947), FVIDDKSG (SEQ ID NO:1948), IFVIDDK (SEQ ID NO:1949), IFVIDDKS (SEQ ID NO:1950), IFVIDDKSG (SEQ ID NO:1951), EEY, IEEY (SEQ ID NO:1952), EEYT (SEQ ID NO:1953), VEEY (SEQ ID NO:1954), IEEYT (SEQ ID NO:1955), VIEEYT (SEQ ID NO:1956), EEYTG (SEQ ID NO:1957), IEEYTG (SEQ ID NO:1958), VIEEYTG (SEQ ID NO:1959), FVIEEY (SEQ ID NO:1960), FVIEEYT (SEQ ID NO:1961), FVIEEYTG (SEQ ID NO:1962), FFVIEEY (SEQ ID NO:1963), FFVIEEYT (SEQ ID NO:1964), FFVIEEYTG (SEQ ID NO:1965), EAQ, VEAQ (SEQ ID NO:1966), EAQT (SEQ ID NO:1967), SVEAQ (SEQ ID NO:1968), VEAQT (SEQ ID NO:1969), SVEAQT (SEQ ID NO:1970), EAQTG (SEQ ID NO:1971), VEAQTG (SEQ ID NO:1972), SVEAQTG (SEQ ID NO:1973), FSVEAQ (SEQ ID NO:1974), FSVEAQT (SEQ ID NO:1975), FSVEAQTG (SEQ ID NO:1976), YFSVEAQ (SEQ ID NO:1977), YFSVEAQT (SEQ ID NO:1978) and YFSVEAQTG (SEQ ID NO:1979).

Still further CAR sequences that may be included in a modulating agent are cadherin-5 CAR sequences such as DAE, VDAE (SEQ ID NO:1980), DAET (SEQ ID NO:1981), RVDAE (SEQ ID NO:1982), VDAET (SEQ ID NO:1983), RVDAET (SEQ ID NO:1984), DAETG (SEQ ID NO:1985), VDAETG (SEQ ID NO:1986), RVDAETG (SEQ ID NO:1987), FRVDAE (SEQ ID NO:1988), FRVDAET (SEQ ID NO:1989), FRVDAETG (SEQ ID NO:1990), VFRVDAE (SEQ ID NO:1991), VFRVDAET (SEQ ID NO:1992) and VFRVDAETG (SEQ ID NO:370).

Using linkers, such modulating agents may form linear or branched structures. Within one embodiment, modulating agents having a branched structure comprise four different CAR sequences, such as IFVIDDKSG (SEQ ID NO:368, RGD, YIGSR (SEQ ID NO:1933 and HAV. Bi-functional modulating agents that comprise a desmosomal cadherin CAR sequence joined via a linker to a classical cadherin CAR sequence are also preferred for certain embodiments. As noted above, linkers preferably produce a distance between CAR sequences ranging from 0.1 to 10,000 nm, more preferably ranging from 0.1400 nm. A separation distance between recognition sites may generally be determined according to the desired function of the modulating agent.

The total number of CAR sequences (including the desmosomal cadherin CAR sequence, with or without other CAR sequences derived from one or more different adhesion molecules) present within a modulating agent may range from 1 to a large number, such as 100, preferably from 1 to 10, and more preferably from 1 to 5. Peptide modulating agents comprising multiple CAR sequences typically contain from 6 to about 1000 amino acid residues, preferably from 6 to 50 residues. When non-peptide linkers are employed, each CAR sequence of the modulating agent is present within a peptide that generally ranges in size from 3 to 50 residues in length, preferably from 4 to 25 residues, and more preferably from 5 to 15 residues.

As noted above, modulating agents may be polypeptides or salts thereof, containing only amino acid residues linked by peptide bonds, or may contain non-peptide regions, such as linkers. Peptide regions of a modulating agent may comprise residues of L-amino acids, D-amino acids, or any combination thereof. Amino acids may be from natural or non-natural sources, provided that at least one amino group and at least one carboxyl group are present in the molecule; α- and β-amino acids are generally preferred. The 20 L-amino acids commonly found in proteins are identified herein by the conventional three-letter or one-letter abbreviations, and the corresponding D-amino acids are designated by a lower case one letter symbol.

A modulating agent may also contain rare amino acids (such as 4-hydroxyproline or hydroxylysine), organic acids or amides and/or derivatives of common amino acids, such as amino acids having the C-terminal carboxylate esterified (e.g., benzyl, methyl or ethyl ester) or amidated and/or having modifications of the N-terminal amino group (e.g., acetylation or alkoxycarbonylation), with or without any of a wide variety of side-chain modifications and/or substitutions (e.g., methylation, benzylation, t-butylation, tosylation, alkoxycarbonylation, and the like). Preferred derivatives include amino acids having a C-terminal amide group. Residues other than common amino acids that may be present with a modulating agent include, but are not limited to, 2-mercaptoaniline, 2-mercaptoproline, ornithine, diaminobutyric acid, α-aminoadipic acid, m-aminomethylbenzoic acid and α,β-diaminopropionic acid.

Peptide modulating agents (and peptide portions of modulating agents) as described herein may be synthesized by methods well known in the art, including chemical synthesis and recombinant DNA methods. For modulating agents up to about 50 residues in length, chemical synthesis may be performed using solution or solid phase peptide synthesis techniques, in which a peptide linkage occurs through the direct condensation of the α-amino group of one amino acid with the α-carboxy group of the other amino acid with the elimination of a water molecule. Peptide bond synthesis by direct condensation, as formulated above, requires suppression of the reactive character of the amino group of the first and of the carboxyl group of the second amino acid. The masking substituents must permit their ready removal, without inducing breakdown of the labile peptide molecule.

In solution phase synthesis, a wide variety of coupling methods and protecting groups may be used (see Gross and Meienhofer, eds., "The Peptides: Analysis, Synthesis, Biology," Vol. 1–4 (Academic Press, 1979); Bodansky and Bodansky, "The Practice of Peptide Synthesis," 2d ed. (Springer Verlag, 1994)). In addition, intermediate purification and linear scale up are possible. Those of ordinary skill in the art will appreciate that solution synthesis requires consideration of main chain and side chain protecting groups and activation method. In addition, careful segment selection is necessary to minimize racemization during segment condensation. Solubility considerations are also a factor.

Solid phase peptide synthesis uses an insoluble polymer for support during organic synthesis. The polymer-supported peptide chain permits the use of simple washing and filtration steps instead of laborious purifications at intermediate steps. Solid-phase peptide synthesis may generally be performed according to the method of Merrifield et al., *J. Am. Chem. Soc.* 85:2149, 1963, which involves assembling a linear peptide chain on a resin support using protected amino acids. Solid phase peptide synthesis typically utilizes either the Boc or Fmoc strategy. The Boc strategy uses a 1% cross-linked polystyrene resin. The standard protecting group for α-amino functions is the tert-butyloxycarbonyl (Boc) group. This group can be removed with dilute solutions of strong acids such as 25% trifluoroacetic acid (TFA). The next Boc-amino acid is typically coupled to the amino acyl resin using dicyclohexylcarbodiimide (DCC). Following completion of the assembly, the peptide-resin is treated with anhydrous HF to cleave the benzyl ester link and liberate the free peptide. Side-chain functional groups are usually blocked during synthesis by benzyl-derived blocking groups, which are also cleaved by HF. The free peptide is then extracted from the resin with a suitable solvent, purified and characterized. Newly synthesized peptides can be purified, for example, by gel filtration, HPLC, partition chromatography and/or ion-exchange chromatography, and may be characterized by, for example, mass spectrometry or amino acid sequence analysis. In the Boc strategy, C-terminal amidated peptides can be obtained using benzhydrylamine or methylbenzhydrylamine resins, which yield peptide amides directly upon cleavage with HF.

In the procedures discussed above, the selectivity of the side-chain blocking groups and of the peptide-resin link depends upon the differences in the rate of acidolytic cleavage. Orthoganol systems have been introduced in which the side-chain blocking groups and the peptide-resin link are completely stable to the reagent used to remove the α-protecting group at each step of the synthesis. The most common of these methods involves the 9-fluorenylmethyloxycarbonyl (Fmoc) approach. Within this method, the side-chain protecting groups and the peptide-resin link are completely stable to the secondary amines used for cleaving the N-α-Fmoc group. The side-chain protection and the peptide-resin link are cleaved by mild acidolysis. The repeated contact with base makes the Merrifield resin unsuitable for Fmoc chemistry, and p-alkoxybenzyl esters linked to the resin are generally used. Deprotection and cleavage are generally accomplished using TFA.

Those of ordinary skill in the art will recognize that, in solid phase synthesis, deprotection and coupling reactions must go to completion and the side-chain blocking groups must be stable throughout the entire synthesis. In addition, solid phase synthesis is generally most suitable when peptides are to be made on a small scale.

Acetylation of the N-terminus can be accomplished by reacting the final peptide with acetic anhydride before cleavage from the resin. C-amidation is accomplished using an appropriate resin such as methylbenzhydrylamine resin using the Boc technology.

Following synthesis of a linear peptide, with or without N-acetylation and/or C-amidation, cyclization may be achieved if desired by any of a variety of techniques well known in the art. Within one embodiment, a bond may be generated between reactive amino acid side chains. For example, a disulfide bridge may be formed from a linear peptide comprising two thiol-containing residues by oxidizing the peptide using any of a variety of methods. Within one such method, air oxidation of thiols can generate disulfide linkages over a period of several days using either basic or neutral aqueous media. The peptide is used in high dilution to minimize aggregation and intermolecular side reactions. This method suffers from the disadvantage of being slow but has the advantage of only producing $H_2O$ as a side product. Alternatively, strong oxidizing agents such as $I_2$ and $K_3Fe(CN)_6$ can be used to form disulfide linkages. Those of ordinary skill in the art will recognize that care must be taken not to oxidize the sensitive side chains of Met, Tyr, Trp or His. Cyclic peptides produced by this method require purification using standard techniques, but this oxidation is applicable at acid pHs. Oxidizing agents also allow concurrent deprotection/oxidation of suitable S-protected linear precursors to avoid premature, nonspecific oxidation of free cysteine.

DMSO, unlike $I_2$ and $K_3Fe(CN)_6$, is a mild oxidizing agent which does not cause oxidative side reactions of the nucleophilic amino acids mentioned above. DMSO is miscible with $H_2O$ at all concentrations, and oxidations can be performed at acidic to neutral pHs with harmless byproducts. Methyltrichlorosilane-diphenylsulfoxide may alternatively be used as an oxidizing agent, for concurrent deprotection/oxidation of S-Acm, S-Tacm or S-t-Bu of cysteine without affecting other nucleophilic amino acids. There are no polymeric products resulting from intermolecular disulfide bond formation. Suitable thiol-containing residues for use in such oxidation methods include, but are not limited to, cysteine, β,β-dimethyl cysteine (penicillamine or Pen), β,β-tetramethylene cysteine (Tmc), β,β- pentamethylene cysteine (Pmc), β-mercaptopropionic acid (Mpr), β,β-pentamethylene-β-mercaptopropionic acid (Pmp), 2-mercaptobenzene, 2-mercaptoaniline and 2-mercaptoproline. Peptides containing such residues are illustrated by the following representative formulas, in which the desmosomal cadherin is a desmoglein, the underlined portion is cyclized, N-acetyl groups are indicated by N—Ac and C-terminal amide groups are represented by —NH$_2$:

ing the O-acylurea to an active ester by reaction with an N-hydroxy compound such as 1-hydroxybenzotriazole, 1-hydroxysuccinimide, 1-hydroxynorbornene carboxamide or ethyl 2-hydroximino-2-cyanoacetate. In addition to minimizing O→N migration, these additives also serve as catalysts during cyclization and assist in lowering racemization. Alternatively, cyclization can be performed using the azide method, in which a reactive azide intermediate is generated from an alkyl ester via a hydrazide. Hydrazinolysis of the

| | | |
|---|---|---|
| i) | N-Ac-<u>Cys-Asn-Gln-Lys-Cys</u>-NH$_2$ | (SEQ ID NO:62) |
| ii) | N-Ac-<u>Cys-Ile-Asn-Gln-Lys-Thr-Gly-Cys</u>-NH$_2$ | (SEQ ID NO:1993) |
| iii) | N-Ac-<u>Cys-Ile-Asn-Gln-Lys-Cys</u>-NH$_2$ | (SEQ ID NO:1994) |
| iv) | N-Ac-<u>Cys-Asn-Gln-Lys-Thr-Cys</u>-NH$_2$ | (SEQ ID NO:1995) |
| v) | N-Ac-<u>Cys-Ile-Asn-Gln-Lys-Thr-Cys</u>-NH$_2$ | (SEQ ID NO:1996) |
| vi) | N-Ac-<u>Cys-Asn-Gln-Lys-Thr-Cys</u>-OH | (SEQ ID NO:1997) |
| vii) | H-<u>Cys-Ile-Asn-Gln-Lys-Thr-Cys</u>-NH$_2$ | (SEQ ID NO:1998) |
| viii) | N-Ac-<u>Cys-Asn-Gln-Lys-Pen</u>-NH$_2$ | (SEQ ID NO:1999) |
| ix) | N-Ac-Cys-Phe-Val-Ile-Asn-Gln-Lys-Thr-Gly-Cys-NH$_2$ | (SEQ ID NO:2000) |
| x) | N-Ac-Cys-Ile-Phe-Val-Ile-Asn-Gln-Lys-Thr-Gly-Cys-NH$_2$ | (SEQ ID NO:2001) |
| xi) | N-Ac-Ile-<u>Tmc-Val-Ile-Asn-Gln-Lys-Thr-Cys</u>-Glu-NH$_2$ | (SEQ ID NO:2002) |
| xii) | N-Ac-Ile-<u>Pmc-Val-Ile-Asn-Gln-Lys-Thr-Gly-Cys</u>-NH$_2$ | (SEQ ID NO:2003) |
| xiii) | <u>Mpr-Val-Ile-Asn-Gln-Lys-Thr-Gly-Cys</u>-NH$_2$ | (SEQ ID NO:2004) |
| xiv) | <u>Pmp-Val-Ile-Asn-Gln-Lys-Thr-Gly-Cys</u>-NH$_2$ | (SEQ ID NO:2005) |

It will be readily apparent to those of ordinary skill in the art that, within each of these representative formulas, any of the above thiol-containing residues may be employed in place of one or both of the thiol-containing residues recited. Similar formulas comprising different nonclassical cadherin CAR sequences may be generated by those of ordinary skill in the art, based on the CAR sequences provided herein.

Within another embodiment, cyclization may be achieved by amide bond formation. For example, a peptide bond may be formed between terminal functional groups (ie., the amino and carboxy termini of a linear peptide prior to cyclization). One such cyclic peptide comprising a desmoglein CAR sequence is INQKTG (SEQ ID NO:67) with or without an acid through the carbodiimide coupling method (DCC, EDAC) and then reacted with the side chain of any of the thiol containing residues mentioned above to form a thioether linkage. In order to form dithioethers, any two thiol containing side-chains can be reacted with dibromoethane and diisopropylamine in DMF. Examples of thiol-containing linkages are shown below:

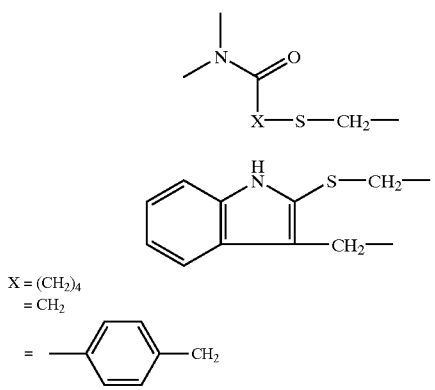

Cyclization may also be achieved using $\delta_1,\delta_1$-Ditryptophan (e.g., Ac-<u>Trp-Asn-Gln-Lys-Trp-OMe</u>) (SEQ ID NO:2007).

The structures and formulas recited herein are provided solely for the purpose of illustration, and are not intended to limit the scope of the cyclic peptides described herein.

For longer modulating agents, recombinant methods are preferred for synthesis. Within such methods, all or part of a modulating agent can be synthesized in living cells, using any of a variety of expression vectors known to those of ordinary skill in the art to be appropriate for the particular host cell. Suitable host cells may include bacteria, yeast cells, mammalian cells, insect cells, plant cells, algae and other animal cells (e.g., hybridoma, CHO, myeloma). The DNA sequences expressed in this manner may encode portions of a desmosomal cadherin or other adhesion molecule, or may encode a peptide comprising a desmosomal cadherin analogue or an antibody fragment that specifically binds to a desmosomal cadherin CAR sequence. Such DNA sequences may be prepared based on known cDNA or genomic sequences, or from sequences isolated by screening an appropriate library with probes designed based on the sequences of known desmosomal cadherins. Such screens may generally be performed as described in Sambrook et al., *Molecular Cloning: A Laboratory Manual*, Cold Spring Harbor Laboratories, Cold Spring Harbor, N.Y., 1989 (and references cited therein). Polymerase chain reaction (PCR) may also be employed, using oligonucleotide primers in methods well known in the art, to isolate nucleic acid molecules encoding all or a portion of an endogenous adhesion molecule. To generate a nucleic acid molecule encoding a desired modulating agent, an endogenous cadherin sequence may be modified using well known techniques. For example, portions encoding one or more CAR sequences may be joined, with or without separation by nucleic acid regions encoding linkers, as discussed above. Alternatively, portions of the desired nucleic acid sequences may be synthesized using well known techniques, and then ligated together to form a sequence encoding the modulating agent.

As noted above, polynucleotides may also function as modulating agents. In general, such polynucleotides should be formulated to permit expression of a polypeptide modulating agent following administration to a mammal. Such formulations are particularly useful for therapeutic purposes, as described below. Those of ordinary skill in the art will appreciate that there are many ways to achieve expression of a polynucleotide within a mammal, and any suitable method may be employed. For example, a polynucleotide may be incorporated into a viral vector such as, but not limited to, adenovirus, adeno-associated virus, retrovirus, or vaccinia or other pox virus (e.g., avian pox virus). Techniques for incorporating DNA into such vectors are well known to those of ordinary skill in the art. A retroviral vector may additionally transfer or incorporate a gene for a selectable marker (to aid in the identification or selection of transfected cells) and/or a targeting moiety, such as a gene that encodes a ligand for a receptor on a specific target cell, to render the vector target specific. Targeting may also be accomplished using an antibody, by methods known to those of ordinary skill in the art. Other formulations for polynucleotides for therapeutic purposes include colloidal dispersion systems, such as macromolecule complexes, nanocapsules, microspheres, beads, and lipid-based systems including oil-in-water emulsions, micelles, mixed micelles, and liposomes. A preferred colloidal system for use as a delivery vehicle in vitro and in vivo is a liposome (i.e., an artificial membrane vesicle). The preparation and use of such systems is well known in the art.

As noted above, a modulating agent may additionally, or alternatively, comprise a substance such as an antibody or antigen-binding fragment thereof, that specifically binds to a desmosomal cadherin CAR sequence. As used herein, a substance is said to "specifically bind" to a desmosomal cadherin CAR sequence (with or without flanking amino acids) if it reacts at a detectable level with a peptide containing that sequence, and does not react detectably with peptides containing a different CAR sequence or a sequence in which the order of amino acid residues in the cadherin CAR sequence and/or flanking sequence is altered. Such antibody binding properties may generally be assessed using an ELISA, which may be readily performed by those of ordinary skill in the art and is described, for example, by Newton et al., *Develop. Dynamics* 197:1–13,1993.

Polyclonal and monoclonal antibodies may be raised against a desmosomal cadherin CAR sequence using conventional techniques. See, e.g., Harlow and Lane, *Antibodies: A Laboratory Manual*, Cold Spring Harbor Laboratory, 1988. In one such technique, an immunogen comprising the CAR sequence is initially injected into any of a wide variety of mammals (e.g., mice, rats, rabbits, sheep or goats). The smaller immunogens (ie., less than about 20 amino acids) should be joined to a carrier protein, such as bovine serum albumin or keyhole limpet hemocyanin. Following one or more injections, the animals are bled periodically. Polyclonal antibodies specific for the CAR sequence may then be purified from such antisera by, for example, affinity chromatography using the modulating agent or antigenic portion thereof coupled to a suitable solid support.

Monoclonal antibodies specific for a desmosomal cadherin sequence may be prepared, for example, using the technique of Kohler and Milstein, *Eur. J. Immunol* 6:511–519, 1976, and improvements thereto. Briefly, these methods involve the preparation of immortal cell lines capable of producing antibodies having the desired specificity from spleen cells obtained from an animal immunized as described above. The spleen cells are immortalized by, for example, fusion with a myeloma cell fusion partner, preferably one that is syngeneic with the immunized animal. Single colonies are selected and their culture supernatants tested for binding activity against the modulating agent or antigenic portion thereof. Hybridomas having high reactivity and specificity are preferred.

Monoclonal antibodies may be isolated from the supernatants of growing hybridoma colonies, with or without the use of various techniques known in the art to enhance the yield. Contaminants may be removed from the antibodies by conventional techniques, such as chromatography, gel filtration, precipitation and extraction. Antibodies having the desired activity may generally be identified using immunofluorescence analyses of tissue sections, cell or other samples where the target cadherin is localized.

Within certain embodiments, the use of antigen-binding fragments of antibodies may be preferred. Such fragments include Fab fragments, which may be prepared using standard techniques. Briefly, immunoglobulins may be purified from rabbit serum by affinity chromatography on Protein A bead columns (Harlow and Lane, *Antibodies: A Laboratory Manual*, Cold Spring Harbor Laboratory, 1988; see especially page 309) and digested by papain to yield Fab and Fc fragments. The Fab and Fc fragments may be separated by affinity chromatography on protein A bead columns (Harlow and Lane, 1988, pages 628–29).

Evaluation of Modulating Agent Activity

Modulating agents as described above are capable of modulating one or more desmosomal cadherin-mediated functions. An initial screen for such activity may be performed by evaluating the ability of a modulating agent to bind to a desmosomal cadherin using any binding assay known to those of ordinary skill in the art. For example, a Pharmacia Biosensor machine may be used, as discussed in Jonsson et al., *Biotechniques* 11:520–27, 1991. For example, a modulating agent may comprise a CAR sequence that binds to a desmosomal cadherin. A specific example of a technology that measures the interaction of peptides with molecules can be found in Williams et al., *J. Biol Chem.* 272, 22349–22354, 1997. Alternatively, real-time BIA (Biomolecular Interaction Analysis) uses the optical phenomenon surface plasmon resonance to monitor biomolecular interactions. The detection depends upon changes in the mass concentration of macromolecules at the biospecific interface, which in turn depends upon the immobilization of test molecule or peptide (referred to as the ligand) to the surface of a Biosensor chip, followed by binding of the interacting molecule (referred to as the analyte) to the ligand. Binding to the chip is measured in real-time in arbitrary units of resonance (RU).

By way of example, surface plasmon resonance experiments may be carried out using a BIAcore X™ Biosensor (Pharmacia Ltd., BIAcore, Uppsala, Sweden). Parallel flow cells of CM 5 sensor chips may be derivatized, using the amine coupling method, with streptavidin (200 $\mu$g/ml) in 10 mM Sodium Acetate, pH 4.0, according to the manufacturer's protocol. Approximately 2100–2600 resonance units (RU) of ligand may be immobilized, corresponding to a concentration of about 2.1–2.6 ng/mm$^2$. The chips may then coated be with desmosomal cadherin derivatized to biotin. Any non-specifically bound protein is removed.

To determine binding, test analytes (e.g., peptides containing a desmosomal cadherin CAR sequence) may be placed in running buffer and passed simultaneously over test and control flow cells. After a period of free buffer flow, any analyte remaining bound to the surface may be removed with, for example, a pulse of 0.1% SDS bringing the signal back to baseline. Specific binding to the derivatized sensor chips may be determined automatically by the system by subtraction of test from control flow cell responses. In general, a modulating agent binds to a desmosomal cadherin at a detectable level within such as assay. The level of binding is preferably at least that observed for the full length desmosomal cadherin under similar conditions.

The ability to modulate a desmosomal cadherin-mediated function may be evaluated using any of a variety of in vitro assays designed to measure the effect of the peptide on a response that is generally mediated by the desmosomal cadherin. As noted above, modulating agents may be capable of enhancing or inhibiting a desmosomal cadherin-mediated function.

Certain desmosomal cadherins are associated with adhesion of particular cell types (e.g., epithelial cells). The ability of an agent to modulate cell adhesion may generally be evaluated in vitro by assaying the effect on adhesion between appropriate cells. In general, a modulating agent is an inhibitor of cell adhesion if contact of the test cells with the modulating agent results in a discernible disruption of cell adhesion. Modulating agents that enhance cell adhesion (e.g., agents comprising multiple desmosomal cadherin CAR sequences and/or desmosomal cadherin CAR sequences linked to a support material) are considered to be modulators of cell adhesion if they are capable of promoting cell adhesion, as judged by plating assays to assess cell adhesion to a modulating agent attached to a support material, such as tissue culture plastic.

Within certain cell adhesion assays, the addition of a modulating agent to cells that express a desmosomal cadherin results in disruption of cell adhesion. A "desmosomal cadherin-expressing cell," as used herein, may be any type of cell that expresses a desmosomal cadherin at a detectable level, using standard techniques such as immunocytochemical protocols (e.g., Blaschuk and Farookhi, *Dev. Biol* 136:564–567, 1989). For example, such cells may be plated under standard conditions that, in the absence of modulating agent, permit cell adhesion. In the presence of modulating agent (e.g., 1 mg/mL), disruption of cell adhesion may be determined visually within 24 hours, by observing retraction of the cells from one another and the substratum.

Suitable cells for use within such assays may be any of a variety of cells that express the desmosomal cadherin of interest. Certain cells express one or more cadherins endogenously. In general, MDCK cells or keratinocytes may be used to evaluate desmocollin- or desmoglein-mediated cell adhesion. It will be apparent that other cells may also be used within such assays, provided that the cells express the desmosomal cadherin of interest.

Alternatively, cells that do not naturally express a cadherin may be used within such assays. Such cells may be stably transfected with a polynucleotide (e.g., a cDNA) encoding one or more cadherins of interest, such that the cadherin or cadherins are expressed on the surface of the cell. For example, as noted above, both a desmoglein and a desmocollin may be required for optimal cell adhesion, and such assays may be performed using cells transformed with polynucleotides encoding both of these desmosomal cadherins. Expression of the cadherin(s) may be confirmed by assessing adhesion of the transfected cells, in conjunction with immunocytochemical techniques using antibodies directed against the cadherin of interest. The stably transfected cells that aggregate, as judged by light microscopy, following transfection express sufficient levels of the desmosomal cadherin(s). Preferred cells for use in such assays include L cells, which do not detectably adhere and do not express any cadherin (Nagafuchi et al., *Nature* 329:341–343, 1987). Following transfection of L cells with a cDNA encoding one ore more cadherins, aggregation is observed. Modulating agents that detectably inhibit such aggregation may be used to modulate functions mediated by the cadherin. Such assays have been used for numerous nonclassical cadherins, including OB-cadherin (Okazaki et al., *J. Biol Chem.* 269:12092–98, 1994), cadherin-5 (Breier et al., *Blood* 87:630–641, 1996), cadherin-6 (Mbalaviele et al., *J. Cell Biol* 141:1467–1476, 1998), cadherin-8 (Kido et al., *Genomics* 48:186–194, 1998), cadherin-15 (Shimoyama et al., *J. Biol Chem.* 273:10011–10018, 1998), PB-cadherin (Sugimoto et al., *J. Biol Chem.* 271:11548–11556, 1996), LI-cadherin (Kreft et al., *J. Cell. Biol.* 136:1109–1121, 1997), protocadherin 42 and 43 (Sano et al., *EMBO J.* 12:2249–2256, 1993) and desmosomal cadherins (Marcozzi et al., *J. Cell Sci.* 111:495–509, 1998; Tselepis et al., *Proc. Natl. Acad. Sci. USA* 95:8064–8069, 1998). It will be apparent to those of ordinary skill in the art that assays may be performed in a similar manner for other cadherins.

Transfection of cells for use in cell adhesion assays may be performed using standard techniques and published cadherin sequences. For example, sequences of desmosomal cadherins may be found within references cited herein and in the GenBank database. GenBank accession numbers for certain desmosomal cadherins include: X56654 (human desmoglein 1); Z26317 and S64273 (human desmoglein 2); X72925 (human desmocollin 1); X56807 (human desmocollin 2); X83929 (human desmocollin 3); and D17427 (human desmocollin 4).

By way of example, an assay for evaluating a modulating agent for the ability to inhibit a desmosomal cadherin mediated function may evaluate the effect of a modulating agent on the electrical resistance across a monolayer of cells. For example, Madin Darby canine kidney (MDCK) cells can be exposed to the modulating agent dissolved in medium (e.g., at a final concentration of 0.5 mg/ml for a period of 24 hours). The effect on electrical resistance can be measured using standard techniques. This assay evaluates the effect of a modulating agent on tight junction formation in epithelial cells. In general, the presence of 500 μg/mL modulating agent should result in a statistically significant decrease in electrical resistance after 24 hours.

Other assays involve visual evaluation of cell adhesion, using standard methods. In general, a modulating agent that is derived from a particular desmosomal cadherin CAR sequence (ie., comprises such a CAR sequence, or an analog or mimetic thereof, or an antibody that specifically recognizes such a CAR sequence) and that detectably modulates adhesion of cells that express the same desmosomal cadherin is considered to modulate a function mediated by the desmosomal cadherin.

Other assays may be used to assess the effect of a modulating agent on specific desmosomal cadherin-mediated functions. For example, modulating agents that inhibit interactions of desmogleins and desmocollins may enhance skin permeability. This ability may be assessed by evaluating, for example, the effect of a modulating agent on permeability of adherent epithelial and/or endothelial cell layers (e.g., human skin). Such skin may be derived from a natural source or may be synthetic. Human abdominal skin for use in such assays may generally be obtained from humans at autopsy within 24 hours of death. Briefly, a modulating agent (e.g., 500 μg/ml) and a test marker (e.g., the fluorescent markers Oregon Green™ and Rhodamine Green™ Dextran) may be dissolved in a sterile buffer (e.g., phosphate buffer, pH 7.2), and the ability of the marker to penetrate through the skin and into a receptor fluid (e.g., phosphate buffer) may be measured using a Franz Cell apparatus (Franz, *Curr. Prob. Dermatol.* 7:58–68, 1978; Franz, *J. Invest. Dermatol* 64:190–195, 1975). The penetration of the markers through the skin may be assessed at, for example, 6, 12, 24, 36, and 48 hours after the start of the experiment. In general, a modulating agent that enhances the permeability of human skin results in a statistically significant increase in the amount of marker in the receptor compartment after 6–48 hours in the presence of 500 μg/mL modulating agent.

Modulating Agent Modification and Formulations

A modulating agent as described herein may, but need not, be linked to one or more additional molecules. In particular, as discussed below, it may be beneficial for certain applications to link multiple modulating agents (which may, but need not, be identical) to a support material, such as a single molecule (e.g., keyhole limpet hemocyanin) or a solid support, such as a polymeric matrix (which may be formulated as a membrane or microstructure, such as an ultra thin film), a container surface (e.g., the surface of a tissue culture plate or the interior surface of a bioreactor), or a bead or other particle, which may be prepared from a variety of materials including glass, plastic or ceramics. For certain applications, biodegradable support materials are preferred, such as cellulose and derivatives thereof, collagen, spider silk or any of a variety of polyesters (e.g., those derived from hydroxy acids and/or lactones) or sutures (see U.S. Pat. No. 5,245,012). Within certain embodiments, modulating agents and molecules comprising other CAR sequence(s) (e.g., an HAV or RGD sequence, or an OB-cadherin or cadherin-5 CAR sequence as described above) may be attached to a support such as a polymeric matrix, preferably in an alternating pattern.

Suitable methods for linking a modulating agent to a support material will depend upon the composition of the support and the intended use, and will be readily apparent to those of ordinary skill in the art. Attachment may generally be achieved through noncovalent association, such as adsorption or affinity or, preferably, via covalent attachment (which may be a direct linkage between a modulating agent and functional groups on the support, or may be a linkage by way of a cross-linking agent). Attachment of a modulating agent by adsorption may be achieved by contact, in a suitable buffer, with a solid support for a suitable amount of time. The contact time varies with temperature, but is generally between about 5 seconds and 1 day, and typically between about 10 seconds and 1 hour.

Covalent attachment of a modulating agent to a molecule or solid support may generally be achieved by first reacting the support material with a bifunctional reagent that will also react with a functional group, such as a hydroxyl or amino group, on the modulating agent. For example, a modulating agent may be bound to an appropriate polymeric support or coating using benzoquinone, by condensation of an aldehyde group on the support with an amine and an active hydrogen on the modulating agent or by condensation of an amino group on the support with a carboxylic acid on the modulating agent. A preferred method of generating a linkage is via amino groups using glutaraldehyde. A modulating agent may be linked to cellulose via ester linkages. Similarly, amide linkages may be suitable for linkage to other molecules such as keyhole limpet hemocyanin or other support materials. Multiple modulating agents and/or molecules comprising other CAR sequences may be attached, for example, by random coupling, in which equimolar amounts of such molecules are mixed with a matrix support and allowed to couple at random.

Although modulating agents as described herein may preferentially bind to specific tissues or cells, and thus may be sufficient to target a desired site in vivo, it may be beneficial for certain applications to include an additional targeting agent. Accordingly, a targeting agent may also, or alternatively, be linked to a modulating agent to facilitate targeting to one or more specific tissues. As used herein, a "targeting agent," may be any substance (such as a compound or cell) that, when linked to a modulating agent enhances the transport of the modulating agent to a target tissue, thereby increasing the local concentration of the modulating agent. Targeting agents include antibodies or fragments thereof, receptors, ligands and other molecules that bind to cells of, or in the vicinity of, the target tissue. Known targeting agents include serum hormones, antibodies against cell surface antigens, lectins, adhesion molecules, tumor cell surface binding ligands, steroids, cholesterol, lymphokines, fibrinolytic enzymes and those drugs and proteins that bind to a desired target site. Among the many monoclonal antibodies that may serve as targeting agents are anti-TAC, or other interleukin-2 receptor antibodies; 9.2.27 and NR-ML-05, reactive with the 250 kilodalton human melanoma-associated proteoglycan; and NR-LU-10, reactive with a pancarcinoma glycoprotein. An antibody targeting agent may be an intact (whole) molecule, a fragment thereof, or a functional equivalent thereof. Examples of antibody fragments are F(ab')2, -Fab', Fab and F[v] fragments, which may be produced by conventional methods or by genetic or protein engineering. Linkage is generally covalent and may be achieved by, for example, direct condensation or other reactions, or by way of bi- or multifunctional linkers.

For certain embodiments, it may be beneficial to also, or alternatively, link a drug to a modulating agent. As used herein, the term "drug" refers to any bioactive agent intended for administration to a mammal to prevent or treat a disease or other undesirable condition. Drugs include hormones, growth factors, proteins, peptides and other compounds. The use of certain specific drugs within the context of the present invention is discussed below.

Modulating agents as described herein may be present within a pharmaceutical composition. A pharmaceutical composition comprises one or more modulating agents in combination with one or more pharmaceutically or physiologically acceptable carriers, diluents or excipients. Such compositions may comprise buffers (e.g., neutral buffered saline or phosphate buffered saline), carbohydrates (e.g., glucose, mannose, sucrose or dextrans), mannitol, proteins, polypeptides or amino acids such as glycine, antioxidants, chelating agents such as EDTA or glutathione, adjuvants (e.g., aluminum hydroxide) and/or preservatives. Within yet other embodiments, compositions of the present invention may be formulated as a lyophilizate. One or more modulating agents (alone or in combination with a targeting agent and/or drug) may, but need not, be encapsulated within liposomes using well known technology. Compositions of the present invention may be formulated for any appropriate manner of administration, including for example, topical, oral, nasal, intravenous, intracranial, intraperitoneal, subcutaneous, or intramuscular administration.

For certain embodiments, as discussed below, a pharmaceutical composition may further comprise a modulator of cell adhesion that is mediated by one or more molecules other than the particular desmosomal cadherin. Such modulators may generally be prepared as described above, using one or more CAR sequences and/or antibodies thereto. Such compositions are particularly useful for situations in which it is desirable to inhibit cell adhesion mediated by multiple cell adhesion molecules, such as other members of the cadherin gene superfamily such as the classical cadherins (e.g., N-cadherin and E-cadherin); nonclassical cadherins, integrins; occludin; claudins; N-CAM and/or extracellular matrix proteins such as laminin, fibronectin, collagens, vitronectin, entactin and tenascin.

A pharmaceutical composition may also, or alternatively, contain one or more drugs, which may be linked to a modulating agent or may be free within the composition. Virtually any drug may be administered in combination with a modulating agent as described herein, for a variety of purposes as described below. Examples of types of drugs that may be administered with a modulating agent include analgesics, anesthetics, antianginals, antifungals, antibiotics, anticancer drugs (e.g., taxol or mitomycin C), antiinflammatories (e.g., ibuprofen and indomethacin), anthelmintics, antidepressants, antidotes, antiemetics, antihistamines, antihypertensives, antimalarials, antimicrotubule agents (e.g., colchicine or vinca alkaloids), antimigraine agents, antimicrobials, antiphsycotics, antipyretics, antiseptics, anti-signaling agents (e.g., protein kinase C inhibitors or inhibitors of intracellular calcium mobilization), antiarthritics, antithrombin agents, antituberculotics, antitussives, antivirals, appetite suppressants, cardioactive drugs, chemical dependency drugs, cathartics, chemotherapeutic agents, coronary, cerebral or peripheral vasodilators, contraceptive agents, depressants, diuretics, expectorants, growth factors, hormonal agents, hypnotics, immunosuppression agents, narcotic antagonists, parasympathomimetics, sedatives, stimulants, sympathomimetics, toxins (e.g., cholera toxin), tranquilizers and urinary antiinfectives.

For imaging purposes, any of a variety of diagnostic agents may be incorporated into a pharmaceutical composition, either linked to a modulating agent or free within the composition. Diagnostic agents include any substance administered to illuminate a physiological function within a patient, while leaving other physiological functions generally unaffected. Diagnostic agents include metals, radioactive isotopes and radioopaque agents (e.g., gallium, technetium, indium, strontium, iodine, barium, bromine and phosphorus-containing compounds), radiolucent agents, contrast agents, dyes (e.g., fluorescent dyes and chromophores) and enzymes that catalyze a colorimetric or fluorometric reaction. In general, such agents may be attached using a variety of techniques as described above, and may be present in any orientation.

The compositions described herein may be administered as part of a sustained release formulation (ie., a formulation such as a capsule or sponge that effects a slow release of modulating agent following administration). Such formulations may generally be prepared using well known technology and administered by, for example, oral, rectal or subcutaneous implantation, or by implantation at the desired target site. Sustained-release formulations may contain a modulating agent dispersed in a carrier matrix and/or contained within a reservoir surrounded by a rate controlling membrane (see, e.g., European Patent Application 710,491 A). Carriers for use within such formulations are biocompatible, and may also be biodegradable; preferably the formulation provides a relatively constant level of modulating agent release. The amount of modulating agent contained within a sustained release formulation depends upon the site of implantation, the rate and expected duration of release and the nature of the condition to be treated or prevented.

Pharmaceutical compositions of the present invention may be administered in a manner appropriate to the disease to be treated (or prevented). Appropriate dosages and a suitable duration and frequency of administration will be determined by such factors as the condition of the patient, the type and severity of the patient's disease and the method of administration. In general, an appropriate dosage and treatment regimen provides the modulating agent(s) in an amount sufficient to provide therapeutic and/or prophylactic benefit. Within particularly preferred embodiments of the invention, a modulating agent or pharmaceutical composition as described herein may be administered at a dosage ranging from 0.001 to 50 mg/kg body weight, preferably from 0.1 to 20 mg/kg, on a regimen of single or multiple daily doses. For topical administration, a cream typically comprises an amount of modulating agent ranging from 0.00001% to 1%, preferably 0.0001% to 0.002%. Fluid compositions typically contain about 10 ng/ml to 5 mg/ml, preferably from about 10 $\mu$g to 2 mg/mL modulating agent. Appropriate dosages may generally be determined using experimental models and/or clinical trials. In general, the use of the minimum dosage that is sufficient to provide effective therapy is preferred. Patients may generally be monitored for therapeutic effectiveness using assays suitable for the condition being treated or prevented, which will be familiar to those of ordinary skill in the art.

Modulating Agent Methods of Use

In general, the modulating agents and compositions described herein may be used for modulating a function, such as cell adhesion, of desmosomal cadherin-expressing cells. Such modulation may be performed in vitro and/or in vivo, preferably in a mammal such as a human, using any method that contacts the desmosomal cadherin-expressing cell with the modulating agent. As noted above, modulating agents for purposes that involve the disruption of desmosomal cadherin-mediated cell adhesion may comprise a desmosomal cadherin CAR sequence, multiple desmosomal cadherin CAR sequences in close proximity and/or a substance (such as an antibody or an antigen-binding fragment thereof) that recognizes a desmosomal cadherin CAR sequence. When it is desirable to also disrupt cell adhesion mediated by other adhesion molecules, a modulating agent may additionally comprise one or more CAR sequences bound by such adhesion molecules (and/or antibodies or fragments thereof that bind such sequences), preferably separated from each other and from the desmosomal cadherin CAR sequence by linkers. As noted above, such linkers may or may not comprise one or more amino acids. For enhancing cell adhesion, a modulating agent may contain multiple desmosomal cadherin CAR sequences derived from one or more desmosomal cadherins or antibodies (or fragments), preferably separated by linkers, and/or may be linked to a single molecule or to a support material as described above. When it is desirable to also enhance cell adhesion mediated by other adhesion molecules, a modulating agent may additionally comprise one or more CAR sequences bound by such adhesion molecules (and/or antibodies or fragments thereof that bind such sequences), preferably separated from each other and from the desmosomal cadherin CAR sequence by linkers.

Certain methods involving the disruption of cell adhesion as described herein have an advantage over prior techniques in that they block tumor cell adhesion. As described in greater detail below, modulating agents as described herein may also be used to disrupt or enhance cell adhesion in a variety of other contexts. Within each of the methods described herein, one or more modulating agents may generally be administered alone, or within a pharmaceutical composition. In each specific method described herein, as noted above, a targeting agent may be employed to increase the local concentration of modulating agent at the target site.

Within one aspect, methods are provided in which cell adhesion is diminished. In one such aspect, the present invention provides methods for reducing unwanted cellular adhesion in a mammal by administering a modulating agent as described herein. Unwanted cellular adhesion can occur, for example, between tumor cells, between tumor cells and normal cells or between normal cells as a result of surgery, injury, chemotherapy, disease, inflammation or other condition jeopardizing cell viability or function. In one particularly preferred embodiment, a modulating agent is further capable of disrupting cell adhesion mediated by multiple adhesion molecules. Such an agent may comprise, in addition to one or more desmosomal cadherin CAR sequences, CAR sequences such as the classical cadherin CAR sequence HAV sequence, an RGD sequence, which is bound by integrins, an OB-cadherin or cadherin-CAR sequence as described above, the occludin CAR sequence LYHY (SEQ ID NO:1937); and/or the claudin CAR sequence IYSY (SEQ ID NO:1936), preferably separated from the desmosomal cadherin CAR sequence via a linker. Alternatively, separate modulators of cell adhesion mediated by other adhesion molecules may be administered in conjunction with the modulating agent(s), either within the same pharmaceutical composition or separately.

Topical administration of the modulating agent(s) is generally preferred, but other means may also be employed. Preferably, a fluid composition for topical administration (comprising, for example, physiological saline) comprises an amount of modulating agent as described above, and more preferably from 10 $\mu$g/mL to 1 mg/mL. Creams may generally be formulated as described above. Topical administration in the surgical field may be given once at the end of surgery by irrigation of the wound or as an intermittent or continuous irrigation with the use of surgical drains in the post-operative period or by the use of drains specifically inserted in an area of inflammation, injury or disease in cases where surgery does not need to be performed. Alternatively, parenteral or transcutaneous administration may be used to achieve similar results.

Certain modulating agents as provided herein may be used to facilitate transdermal drug delivery. Transdermal delivery of drugs is a convenient and non-invasive method that can be used to maintain relatively constant blood levels of a drug. In general, to facilitate drug delivery via the skin, it is necessary to perturb adhesion between the epithelial cells (keratinocytes) and the endothelial cells of the microvasculature. Using currently available techniques, only small, uncharged molecules may be delivered across skin in vivo. The methods described herein are not subject to the same degree of limitation. Accordingly, a wide variety of drugs may be transported across the epithelial and endothelial cell layers of skin, for systemic or topical administration. Such drugs may be delivered to melanomas or may enter the blood stream of the mammal for delivery to other sites within the body.

To enhance the delivery of a drug through the skin, a modulating agent as described herein and a drug are contacted with the skin surface. Multifunctional modulating agents comprising multiple nonclassical cadherin CAR sequences (e.g., a desmosomal cadherin CAR sequence in combination with a CAR sequence derived from OB-cadherin or cadherin-5) may also be used. Such modulating agents may also, or alternatively, comprise the classical cadherin CAR sequence HAV, the fibronectin CAR sequence RGD, which is recognized by integrins, and/or the occludin CAR sequence LYHY (SEQ ID NO:1937). Alternatively, a separate modulator of cell adhesion may be administered in conjunction with the modulating agent(s), either within the same pharmaceutical composition or separately.

Contact may be achieved by direct application of the modulating agent, generally within a composition formulated as a cream or gel, or using any of a variety of skin contact devices for transdermal application (such as those described in European Patent Application No. 566,816 A; U.S. Pat. No. 5,613,958; U.S. Pat. No. 5,505,956). A skin patch provides a convenient method of administration (particularly for slow-release formulations). Such patches may contain a reservoir of modulating agent and drug separated from the skin by a membrane through which the drug diffuses. Within other patch designs, the modulating agent and drug may be dissolved or suspended in a polymer or adhesive matrix that is then placed in direct contact with the patient's skin. The modulating agent and drug may then diffuse from the matrix into the skin. Modulating agent(s) and drug(s) may be contained within the same composition or skin patch, or may be separately administered, although administration at the same time and site is preferred. In general, the amount of modulating agent administered via the skin varies with the nature of the condition to be treated or prevented, but may vary as described above. Such levels may be achieved by appropriate adjustments to the device used, or by applying a cream formulated as described above. Transfer of the drug across the skin and to the target tissue may be predicted based on in vitro studies using, for example, a Franz cell apparatus, and evaluated in vivo by appropriate means that will be apparent to those of ordinary skill in the art. As an example, monitoring of the serum level of the administered drug over time provides an easy measure of the drug transfer across the skin.

Transdermal drug delivery as described herein is particularly useful in situations in which a constant rate of drug delivery is desired, to avoid fluctuating blood levels of a drug. For example, morphine is an analgesic commonly used immediately following surgery. When given intermittently in a parenteral form (intramuscular, intravenous), the patient usually feels sleepy during the first hour, is well during the next 2 hours and is in pain during the last hour because the blood level goes up quickly after the injection and goes down below the desirable level before the 4 hour interval prescribed for re-injection is reached. Transdermal administration as described herein permits the maintenance of constant levels for long periods of time (e.g., days), which allows adequate pain control and mental alertness at the same time. Insulin provides another such example. Many diabetic patients need to maintain a constant baseline level of insulin which is different from their needs at the time of meals. The baseline level may be maintained using transdermal administration of insulin, as described herein. Antibiotics may also be administered at a constant rate, maintaining adequate bactericidal blood levels, while avoiding the high levels that are often responsible for the toxicity (e.g., levels of gentamycin that are too high typically result in renal toxicity).

Drug delivery by the methods of the present invention also provides a more convenient method of drug administration. For example, it is often particularly difficult to administer parenteral drugs to newborns and infants because of the difficulty associated with finding veins of acceptable caliber to catheterize. However, newborns and infants often have a relatively large skin surface as compared to adults. Transdermal drug delivery permits easier management of such patients and allows certain types of care that can presently be given only in hospitals to be given at home. Other patients who typically have similar difficulties with venous catheterization are patients undergoing chemotherapy or patients on dialysis. In addition, for patients undergoing prolonged therapy, transdermal administration as described herein is more convenient than parenteral administration.

Transdermal administration as described herein also allows the gastrointestinal tract to be bypassed in situations where parenteral uses would not be practical. For example, there is a growing need for methods suitable for administration of therapeutic small peptides and proteins, which are typically digested within the gastrointestinal tract, The methods described herein permit administration of such compounds and allow easy administration over long periods of time. Patients who have problems with absorption through their gastrointestinal tract because of prolonged ileus or specific gastrointestinal diseases limiting drug absorption may also benefit from drugs formulated for transdermal application as described herein.

Further, there are many clinical situations where it is difficult to maintain compliance. For example, patients with mental problems (e.g., patients with Alzheimer's disease or psychosis) are easier to manage if a constant delivery rate of drug is provided without having to rely on their ability to take their medication at specific times of the day. Also patients who simply forget to take their drugs as prescribed are less likely to do so if they merely have to put on a skin patch periodically (e.g., every 3 days). Patients with diseases that are without symptoms, like patients with hypertension, are especially at risk of forgetting to take their medication as prescribed.

For patients taking multiple drugs, devices for transdermal application such as skin patches may be formulated with combinations of drugs that are frequently used together. For example, many heart failure patients are given digoxin in combination with furosemide. The combination of both drugs into a single skin patch facilitates administration, reduces the risk of errors (taking the correct pills at the appropriate time is often confusing to older people), reduces the psychological strain of taking "so many pills," reduces skipped dosage because of irregular activities and improves compliance.

The methods described herein are particularly applicable to humans, but also have a variety of veterinary uses, such as the administration of growth factors or hormones (e.g., for fertility control) to an animal.

As noted above, a wide variety of drugs may be administered according to the methods provided herein. Some examples of drug categories that may be administered transdermally include anti-inflammatory drugs (e.g., in arthritis and in other condition) such as all NSAID, indomethacin, prednisone, etc.; analgesics (especially when oral absorption is not possible, such as after surgery, and when parenteral administration is not convenient or desirable), including morphine, codeine, Demerol, acetaminophen and combinations of these (e.g., codeine plus acetaminophen); antibiotics such as Vancomycin (which is not absorbed by the GI tract and is frequently given intravenously) or a combination of INH and Rifampicin (e.g., for tuberculosis); anticoagulants such as heparin (which is not well absorbed by the GI tract and is generally given parenterally, resulting in fluctuation in the blood levels with an increased risk of bleeding at high levels and risks of inefficacy at lower levels) and Warfarin (which is absorbed by the GI tract but cannot be administered immediately after abdominal surgery because of the normal ileus following the procedure); antidepressants (e.g., in situations where compliance is an issue as in Alzheimer's disease or when maintaining stable blood levels results in a significant reduction of anti-cholinergic side effects and better tolerance by patients), such as amitriptylin, imipramin, prozac, etc.; antihypertensive drugs (e.g., to improve compliance and reduce side effects associated with fluctuating blood levels), such as diuretics and beta-blockers (which can be administered by the same patch; e.g., furosemide and propanolol); antipsychotics (e.g., to facilitate compliance and make it easier for care giver and family members to make sure that the drug is received), such as haloperidol and chlorpromazine; and anxiolytics or sedatives (e.g., to avoid the reduction of alertness related to high blood levels after oral administration and allow a continual benefit throughout the day by maintaining therapeutic levels constant).

Numerous other drugs may be administered as described herein, including naturally occurring and synthetic hormones, growth factors, proteins and peptides. For example, insulin and human growth hormone, growth factors like erythropoietin, interleukins and inteferons may be delivered via the skin.

Kits for administering a drug via the skin of a mammal are also provided within the present invention. Such kits generally comprise a device for transdermal application (e.g., a skin patch) in combination with, or impregnated with, one or more modulating agents. A drug may additionally be included within such kits.

Within a related aspect, modulating agents as described herein may be used to increase the permeability of endothelial and epithelial cell layers, thereby facilitating sampling of the blood compartment by passive diffusion. Such methods permit the detection and/or measurement of the levels of specific molecules circulating in the blood. In general, to sample the blood compartment, it is necessary to perturb adhesion between the epithelial cells (keratinocytes) and the endothelial cells of the microvasculature. Using currently available techniques, only small, uncharged molecules may be detected across skin in vivo. The methods described herein are not subject to the same degree of limitation. Accordingly, a wide variety of blood components may be sampled across epithelial and endothelial cell layers. Such sampling may be achieved across any such cell layers, including skin and gums.

For example, application of one or more modulating agents to the skin, via a skin patch as described herein, permits the patch to function like a sponge to accumulate a small quantity of fluid containing a representative sample of the serum. The patch is then removed after a specified amount of time and analyzed by suitable techniques for the compound of interest (e.g., a medication, hormone, growth factor, metabolite or marker). Alternatively, a patch may be impregnated with reagents to permit a color change if a specific substance (e.g., an enzyme) is detected. Substances that can be detected in this manner include, but are not limited to, illegal drugs such as cocaine, HIV enzymes, glucose and PSA. This technology is of particular benefit for home testing kits.

To facilitate sampling of blood in a patient, a modulating agent as described above for enhancing drug delivery is contacted with the skin surface. Modulating agent(s) and reagents for assaying blood components may, but need not, be contained within the same composition or skin patch. In general, the amount of modulating agent administered via the skin may vary as described above. Such levels may be achieved by appropriate adjustments to the device used, or by applying a cream formulated as described above. Transfer of the blood component across the skin may be predicted based on in vitro studies using, for example, a Franz cell apparatus, and evaluated in vivo by appropriate means that will be apparent to those of ordinary skill in the art.

Kits for sampling blood component via, for example, the skin or gums of a mammal, are also provided within the present invention. Such kits generally comprise a device for transdermal application (ie., skin patch) in combination with, or impregnated with, one or more modulating agents. A reagent for detection of a blood component may additionally be included within such kits.

Within a further aspect, methods are provided for enhancing delivery of a drug to a tumor in a mammal, comprising administering a modulating agent in combination with a drug to a tumor-bearing mammal. Such a modulating agent may comprise only a desmosomal cadherin CAR sequence, or may further comprise one or more other nonclassical or classical cadherin CAR sequences, such as a CAR sequence derived from OB-cadherin, cadherin-5, cadherin-6, E-cadherin and/or N-cadherin (e.g., HAV, SHAVSS (SEQ ID NO:2008), AHAVDI (SEQ ID NO:2009) or a analogue of S such a sequence). Bi-functional modulating agents that comprise the desmosomal cadherin CAR sequence with either flanking E-cadherin-specific sequences or flanking N-cadherin-specific sequences joined via a linker to the desmosomal cadherin CAR sequence are also preferred. Preferably, the peptide portion(s) of a modulating agent comprises 6–16 amino acids, since longer peptides are difficult to dissolve in aqueous solution and are more likely to be degraded by peptidases.

In one particularly preferred embodiment, a modulating agent is capable of disrupting cell adhesion mediated by multiple adhesion molecules. For example, a single branched modulating agent (or multiple agents linked to a single molecule or support material) may disrupt adhesion mediated by a desmosomal cadherin, as well as E-cadherin, N-cadherin, occludin, claudin and integrin mediated cell adhesion. Such agents serve as multifunctional disrupters of cell adhesion. Alternatively, a separate modulator may be administered in conjunction with the modulating agent(s), either within the same pharmaceutical composition or separately. Preferred antibody modulating agents include Fab fragments directed against a nonclassical or classical cadherin CAR sequence, as described above. A Fab fragment may be incorporated into a modulating agent or may be present within a separate modulator that is administered concurrently.

Preferably, the modulating agent and the drug are formulated within the same composition or drug delivery device prior to administration. In general, a modulating agent may enhance drug delivery to any tumor (e.g., breast tumor, stomach tumor, ovarian tumor or kidney tumor), and the method of administration may be chosen based on the type of target tumor. For example, injection or topical administration as described above may be preferred for melanomas and other accessible tumors (e.g., metastases from primary ovarian tumors may be treated by flushing the peritoneal cavity with the composition). Other tumors (e.g., breast tumors) may be treated by injection of the modulating agent and the drug (such as mitomycin C) into the site of the tumor. In other instances, the composition may be administered systemically, and targeted to the tumor using any of a variety of specific targeting agents. Suitable drugs may be identified by those of ordinary skill in the art based upon the type of cancer to be treated (e.g., taxol for breast cancer). In general, the amount of modulating agent administered varies with the method of administration and the nature of the tumor, within the typical ranges provided above, preferably ranging from about 1 μg/mL to about 2 mg/mL, and more preferably from about 10 μg/mL to 1 mg/mL. Transfer of the drug to the target tumor may be evaluated by appropriate means that will be apparent to those of ordinary skill in the art. Drugs may also be labeled (e.g., using radionuclides) to permit direct observation of transfer to the target tumor using standard imaging techniques.

Within a related aspect, the present invention provides methods for treating cancer in a mammal. Such a modulating agent may comprise only a desmosomal cadherin CAR sequence, or may further comprise one or more other nonclassical or classical cadherin CAR sequences, such as CAR sequences derived from OB-cadherin, cadherin-5, cadherin-6, E-cadherin and/or N-cadherin. CAR sequences involved in integrin-mediated cell adhesion (e.g., RGD) may also be used. For example, such a modulating agent may further comprise a sequence such as HAV, SHAVSS (SEQ ID NO:2008), AHAVDI (SEQ ID NO:2009), RGD, YIGSR (SEQ ID NO:1933), or a derivative of such a sequence. Preferably, the peptide portion(s) of such modulating agents comprise 6–16 amino acids. Preferred antibody modulating agents include Fab fragments directed against a nonclassical or classical cadherin CAR sequence. The Fab fragments may be either incorporated into a modulating agent or may be present within a separate modulator that is administered concurrently.

A modulating agent may be administered alone (e.g., via the skin) or within a pharmaceutical composition. For melanomas and certain other accessible tumors, injection or topical administration as described above may be preferred. Other tumors (e.g., bladder tumors, bronchial tumors or tracheal tumors) may be treated by injection of the modulating agent into the cavity. In other instances, the composition may be administered systemically, and targeted to the tumor using any of a variety of specific targeting agents, as described above. Preferably, the tumor is a breast tumor, stomach tumor or kidney tumor. In general, the amount of modulating agent administered varies depending upon the method of administration and the nature of the cancer, but may vary within the ranges identified above. The effectiveness of the cancer treatment may be evaluated using well known clinical observations, such as monitoring the level of serum tumor markers (e.g., CEA or PSA).

The addition of a targeting agent as described above may be beneficial, particularly when the administration is systemic. Suitable modes of administration and dosages depend upon the condition to be prevented or treated but, in general, administration by injection is appropriate. Dosages may vary as described above. The effectiveness of the inhibition may be evaluated grossly by assessing the inability of the tumors to maintain their growth and microscopically by observing an absence of nerves at the periphery of the tumor.

In yet another related aspect, the present invention provides methods for inducing apoptosis in a desmosomal cadherin-expressing cell. Such a modulating agent may comprise only a desmosomal cadherin CAR sequence, or may further comprise one or more other nonclassical or classical cadherin CAR sequences, such as HAV, SHAVSS (SEQ ID NO:2008), AHAVDI (SEQ ID NO:2009), RGD, YIGSR (SEQ ID NO:1933) or an analogue of such a sequence. Preferably, the peptide portion(s) of such modulating agents comprise 6–16 amino acids. Preferred antibody modulating agents include Fab fragments directed against a nonclassical or classical cadherin CAR sequence. The Fab fragments may be either incorporated into a modulating agent or within a separate modulator that is administered concurrently. Administration may be topical, via injection or by other means, and the addition of a targeting agent may be beneficial, particularly when the administration is systemic. Suitable modes of administration and dosages depend upon the location and nature of the cells for which induction of apoptosis is desired but, in general, dosages may vary as described above. A biopsy may be performed to evaluate the level of induction of apoptosis.

In certain other aspects, the present invention provides methods for enhancing adhesion of desmosomal cadherin-expressing cells. Within certain embodiments, a modulating agent may be linked to a solid support, resulting in a matrix that comprises multiple modulating agents. Within one such embodiment, the support is a polymeric matrix to which modulating agents and molecules comprising other CAR sequence(s) are attached (e.g., modulating agents and molecules comprising either HAV or RGD sequences may be attached to the same matrix, preferably in an alternating pattern). Such matrices may be used in contexts in which it is desirable to enhance adhesion mediated by multiple cell adhesion molecules. Alternatively, the modulating agent itself may comprise multiple desmosomal cadherin CAR sequences or antibodies (or fragments thereof), separated by linkers as described above. Either way, the modulating agent(s) function as a "biological glue" to bind multiple desmosomal cadherin-expressing cells within a variety of contexts.

Within one such aspect, modulating agents comprising the desmosomal cadherin CAR sequence and/or multiple modulating agents linked to a single molecule or support material may be used to facilitate wound healing and/or reduce scar tissue in a mammal. Such a modulating agent may comprise one desmosomal cadherin CAR sequence, or may comprise multiple such sequences (e.g., a desmoglein CAR sequence and a desmocollin CAR sequence). Optionally, a modulating agent may further comprise one or more other nonclassical cadherin CAR sequences, such as CAR sequences derived from OB-cadherin or cadherin-5 and/or one or more classical cadherin CAR sequences, including HAV, SHAVSS (SEQ ID NO:2008), AHAVDI (SEQ ID NO:2009), or an analogue of such a sequence. Preferred antibody modulating agents include Fab fragments directed against either the nonclassical cadherin or E-cadherin CAR sequences. Modulating agents that are linked to a biocompatible and biodegradable matrix such as cellulose or collagen are particularly preferred. For use within such methods, a modulating agent should have a free amino or hydroxyl group. The modulating agents are generally administered topically to the wound, where they may facilitate closure of the wound and may augment, or even replace, stitches. Similarly, administration of matrix-linked modulating agents may facilitate cell adhesion in skin grafting and prosthetic implants, and may prolong the duration and usefulness of collagen injection. In general, the amount of matrix-linked modulating agent administered to a wound, graft or implant site varies with the severity of the wound and/or the nature of the wound, graft, or implant, but may vary as discussed above. Multifunctional modulating agents comprising a desmosomal cadherin sequence, a classical cadherin CAR sequence (HAV), and the CAR sequence bound by certain integrins (RGD) may also be used as potent stimulators of wound healing and/or to reduce scar tissue. Alternatively, one or more separate modulators of classical cadherin- or integrin-mediated cell adhesion may be administered in conjunction with the modulating agent(s), either within the same pharmaceutical composition or separately.

Within further aspects, modulating agents may be used for the treatment of autoimmune blistering disorders, such as pemphigus vulgaris, pemphigus foliaceus and intercellular IgA dermatosis. These disorders are pathological conditions in which a patient begins to develop antibodies against one or more desmosomal cadherins. In consequence, adhesion of skin cells begins to fail, resulting in various kinds of blistering. The use of modulating agents to enhance desmosomal cadherin-mediated cell adhesion may alleviate symptoms of such disorders. Optionally, such methods would be performed in conjunction with a method for eliminating the anti-cadherin antibodies. Modulating agents for use in such therapies may comprise one desmosomal cadherin CAR sequence or, preferably, comprise a desmoglein CAR sequence and a desmocollin CAR sequence. Optionally, a modulating agent further comprises one or more other nonclassical cadherin CAR sequences, such as CAR sequences derived from OB-cadherin or cadherin-5 and/or one or more classical cadherin CAR sequences, including HAV, SHAVSS (SEQ ID NO:2008), AHAVDI (SEQ ID NO:2009), or an analogue of such a sequence. Preferred antibody modulating agents include Fab fragments directed against either the nonclassical cadherin or E-cadherin CAR sequences. Modulating agents that are linked to a biocompatible and biodegradable matrix such as cellulose or collagen are particularly preferred. For use within such methods, a modulating agent should have a free amino or hydroxyl group. The modulating agents are generally administered topically to the site of blisters. In general, the amount of matrix-linked modulating agent administered to a blister site varies with the severity of the condition, and generally ranges as discussed above. Multi-functional modulating agents comprising one or more desmosomal cadherin sequences, a classical cadherin CAR sequence (HAV), and the CAR sequence bound by certain integrins (RGD) may also be used. Alternatively, one or more separate modulators of classical cadherin- or integrin-mediated cell adhesion may be administered in conjunction with the modulating agent(s), either within the same pharmaceutical composition or separately.

Within another aspect, one or more modulating agents may be linked to the interior surface of a tissue culture plate or other cell culture support, such as for use in a bioreactor. Such linkage may be performed by any suitable technique, as described above. Modulating agents linked in this fashion may generally be used to immobilize cadherin-expressing cells. For example, dishes or plates coated with one or more modulating agents may be used to immobilize cadherin-expressing cells within a variety of assays and screens. Within bioreactors (i.e., systems for large scale production of cells or organoids), modulating agents may generally be used to improve cell attachment and stabilize cell growth. Modulating agents may also be used within bioreactors to support the formation and function of highly differentiated organoids derived, for example, from dispersed populations of fetal mammalian cells. Bioreactors containing biomatrices of modulating agent(s) may also be used to facilitate the production of specific proteins.

Modulating agents as described herein may be used within a variety of bioreactor configurations. In general, a bioreactor is designed with an interior surface area sufficient to support large numbers of adherent cells. This surface area can be provided using membranes, tubes, microtiter wells, columns, hollow fibers, roller bottles, plates, dishes, beads or a combination thereof. A bioreactor may be compartmentalized. The support material within a bioreactor may be any suitable material known in the art; preferably, the support material does not dissolve or swell in water. Preferred support materials include, but are not limited to, synthetic polymers such as acrylics, vinyls, polyethylene, polypropylene, polytetrafluoroethylene, nylons, polyurethanes, polyamides, polysulfones and poly(ethylene terephthalate); ceramics; glass and silica.

Other aspects of the present invention provide methods that employ antibodies raised against a desmosomal CAR sequence for diagnostic and assay purposes. Assays typically involve using an antibody to detect the presence or absence of a desmosomal cadherin (free or on the surface of a cell), or proteolytic fragments containing one or more EC domains in a suitable biological sample, such as tumor or normal tissue biopsies, blood, lymph node, serum or urine samples, or other tissue, homogenate, or extract thereof obtained from a patient.

There are a variety of assay formats known to those of ordinary skill in the art for using an antibody to detect a target molecule in a sample. See, e.g., Harlow and Lane, *Antibodies: A Laboratory Manual,* Cold Spring Harbor Laboratory, 1988. For example, the assay may be performed in a Western blot format, wherein a protein preparation from the biological sample is submitted to gel electrophoresis, transferred to a suitable membrane and allowed to react with the antibody. The presence of the antibody on the membrane may then be detected using a suitable detection reagent, as described below.

In another embodiment, the assay involves the use of antibody immobilized on a solid support to bind to the target cadherin, or a proteolytic fragment containing an extracellular domain and encompassing a CAR sequence, and remove it from the remainder of the sample. The bound cadherin may then be detected using a second antibody or reagent that contains a reporter group. Alternatively, a competitive assay may be utilized, in which a cadherin is labeled with a reporter group and allowed to bind to the immobilized antibody after incubation of the antibody with the sample. The extent to which components of the sample inhibit the binding of the labeled cadherin to the antibody is indicative of the reactivity of the sample with the immobilized antibody, and as a result, indicative of the level of the cadherin in the sample.

The solid support may be any material known to those of ordinary skill in the art to which the antibody may be attached, such as a test well in a microtiter plate, a nitrocellulose filter or another suitable membrane. Alternatively, the support may be a bead or disc, such as glass, fiberglass, latex or a plastic such as polystyrene or polyvinylchloride. The antibody may be immobilized on the solid support using a variety of techniques known to those in the art, which are amply described in the patent and scientific literature.

In certain embodiments, the assay for detection of a desmosomal cadherin in a sample is a two-antibody sandwich assay. This assay may be performed by first contacting an antibody that has been immobilized on a solid support, commonly the well of a microtiter plate, with the biological sample, such that the desmosomal cadherin within the sample is allowed to bind to the immobilized antibody (a 30 minute incubation time at room temperature is generally sufficient). Unbound sample is then removed from the immobilized cadherin-antibody complexes and a second antibody (containing a reporter group such as an enzyme, dye, radionuclide, luminescent group, fluorescent group or biotin) capable of binding to a different site on the cadherin is added. The amount of second antibody that remains bound to the solid support is then determined using a method appropriate for the specific reporter group. The method employed for detecting the reporter group depends upon the nature of the reporter group. For radioactive groups, scintillation counting or autoradiographic methods are generally appropriate. Spectroscopic methods may be used to detect dyes, luminescent groups and fluorescent groups. Biotin may be detected using avidin, coupled to a different reporter group (commonly a radioactive or fluorescent group or an enzyme). Enzyme reporter groups may generally be detected by the addition of substrate (generally for a specific period of time), followed by spectroscopic or other analysis of the reaction products. Standards and standard additions may be used to determine the level of cadherin in a sample, using well known techniques.

Such immunoassays may be used, for example, in the diagnosis and monitoring of conditions associated with abnormal desmosomal cadherin expression. As noted above, such conditions include autoimmune blistering disorders, such as pemphigus vulgaris, pemphigus foliaceus and intercellular IgA dermatosis. In general, the presence or absence of such a condition in a patient may be determined by (a) contacting a biological sample obtained from a patient with an antibody or antigen-binding fragment thereof, (b) detecting in the sample a level or pattern of polypeptide that binds to the antibody or fragment thereof, and (c) comparing the level or pattern of polypeptide with a predetermined cut-off value or a normal pattern. In general, these diseases are associated with an autoimmune response against desmosomal cadherins, which causes the internalization of these cadherins. Such internalization may be visualized as patchy cytoplasmic granules in stained biopsy sections of lesional and perilesional keratinocytes (see Iwatsuki et al., *Br. J. Dermatol* 140:35–43). These granules are not detected in normal patients.

Immunoassays may further be used to differentiate between benign skin lesions, such as keratoacanthoma, and squamous cell carcinoma. The location of desmoglein staining, in particular, may be used to differentiate between a keratoacanthoma and a carcinoma (see Krunic et al., *Acta Derm. Venereol* 76:394–398, 1996). In general, extensive pericellular staining indicates a keratoacanthoma. Focal pericellular staining indicates a keratoacanthoma or a well-differentiated squamous cell carcinoma. No staining or juxtanuclear staining indicates a poorly differentiated squamous cell carcinoma. Thus, a reduction of pericellular staining (as determined visually or quantitatively, as a reduction of 50%) is indicative of squamous cell carcinoma.

The present invention also provides kits for use in such immunoassays. Such kits generally comprise one or more antibodies, as described above. In addition, one or more additional compartments or containers of a kit generally enclose elements, such as reagents, buffers and/or wash solutions, to be used in the immunoassay.

Within further aspects, modulating agents or antibodies (or fragments thereof) may be used to facilitate cell identification and sorting in vitro or imaging in vivo, permitting the selection of cells expressing the desmosomal cadherin (or different desmosomal cadherin levels). Preferably, the modulating agent(s) or antibodies for use in such methods are linked to a detectable marker. Suitable markers are well known in the art and include radionuclides, luminescent groups, fluorescent groups, enzymes, dyes, constant immunoglobulin domains and biotin. Within one preferred embodiment, a modulating agent linked to a fluorescent marker, such as fluorescein, is contacted with the cells, which are then analyzed by fluorescence activated cell sorting (FACS).

Antibodies or fragments thereof may also be used within screens of combinatorial or other nonpeptide-based libraries to identify other compounds capable of modulating desmosomal cadherin-mediated cell adhesion. Such screens may generally be performed using an ELISA or other method well known to those of ordinary skill in the art that detect compounds with a shape and structure similar to that of the modulating agent. In general, such screens may involve contacting an expression library producing test compounds with an antibody, and detecting the level of antibody bound to the candidate compounds. Compounds for which the antibody has a higher affinity may be further characterized as described herein, to evaluate the ability to modulate OB-cadherin-mediated cell adhesion.

The following Example is offered by way of illustration and not by way of limitation.

EXAMPLE

Preparation of Representative Modulating Agents

This Example illustrates the solid phase synthesis of representative peptide modulating agents.

The peptides were synthesized on a 431A Applied Biosystems peptide synthesizer using p-Hydroxymethylphenoxymethyl polystyrene (HMP) resin and standard Fmoc chemistry. After synthesis and deprotection, the peptides were de-salted on a Sephadex G-10 column and lyophilized. The peptides were analyzed for purity by analytical HPLC, and in each case a single peak was observed. Peptides were made as stock solutions at 10 to 25 mg/mL in dimethylsulfoxide (DMSO) or water and stored at −20° C. before use.

From the foregoing it will be appreciated that, although specific embodiments of the invention have been described herein for purposes of illustration, various modifications may be made without deviating from the spirit and scope of the invention. Accordingly, the invention is not limited except as by the appended claims.

SEQUENCE LISTING (2009 sequences)

SEQ ID NO: 1 - protein, 5 aa, Unknown
  Classical cadherin calcium binding motif
  VARIANT (2)...(2): Xaa = any amino acid
DXNDN

SEQ ID NO: 2 - protein, 4 aa, Unknown
  Classical cadherin calcium binding motif
LDRE

SEQ ID NO: 3 - protein, 9 aa, Unknown
  Modulation agent comprising general formula for desmoglein or desmocollin cell adhesion recognition sequence
  VARIANT (1)...(1): Xaa = any amino acid
  VARIANT (3)...(3): Xaa = any amino acid
  VARIANT (4)...(4): Xaa = Isoleucine, Leucine or Valine
  VARIANT (5)...(5): Xaa = Aspartic Acid, Asparagine, or Glutamic Acid
  VARIANT (6)...(7): Xaa = any amino acid
  VARIANT (8)...(8): Xaa = Serine, Threonine, Asparagine
XFXXXXXXG

SEQ ID NO: 4 - protein, 110 aa, Homo sapiens
RSKRGWVWNQFFVIEEYTGPDPVLVGRLHSDIDSGDGNIKYILSGEGAGTIFVIDDKSGNIHATKTLDREERAQYTLMAQAVDRDTNRPLEPPSEFIVKVQDINDNPPEF

SEQ ID NO: 5 - protein, 109 aa, Homo sapiens
LHETYHANVPERSNVGTSVIQVTASDADDPTYGNSAKLVYSILEGQPYFSVEAQTGIIRTALPNMDREAKEEYHVVIQAKDMGGHMGGLSGTTKVTITLTDVNDNPPKF

SEQ ID NO: 6 - protein, 108 aa, Homo Sapiens
RQKRDWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVF

SEQ ID NO: 7 - protein, 110 aa, Homo Sapiens
RSKRSWMWNQFFLLEEYTGSDYQYVGKLHSDQDRGDGSLKYILSGDGAGDLFIINENTGDIQATKRLDREEKPVYILRAQAINRRTGRPVEPESEFIIKIHDINDNEPIF

SEQ ID NO: 8 - protein, 109 aa, Homo Sapiens
TKEVYTATVPEMSDVGTFVVQVTATDADDPTYGNSAKVVYSILQGQPYFSVESETGIIKTALLNMDRENREQYQVVIQAKDMGGQMGGLSGTTTVNITLTDVNDNPPRF

SEQ ID NO: 9 - protein, 105 aa, Homo Sapiens
SKLAYILQIREDAQINTTIGSVTAQDPDAARNPVKYSVDRHTDMDRIFNIDSGNGSIFTSKLLDRETLLWHNITVIATEINNPKQSSRVPLYIKVLDVNDNAPEF

SEQ ID NO: 10 - protein, 110 aa, Gallus gallus
RTKRSWVWNQFFVLEEYMGSDPLYVGKLHSDVDKGDGSIKYILSGEGASSIFIIDENTGDIHATKRLDREEQAYYTLRAQAHDRLTNKPVEPESEFVIKIQDINDNEPKF

SEQ ID NO: 11 - protein, 109 aa, Gallus gallus
LDGPYTAGVPEMSPVGTSVVQVTATDADDPTYGNSARVVYSILQGQPYFSVEPKTGIIKTALPNMDREAKDQYLLVIQAKDMVGQNGGLSGTTSVTVTLTDVNDNPPRF

SEQ ID NO: 12 - protein, 105 aa, Gallus gallus
TSRLYSMVVSEAAKVGTIIGTVAAHDPDASNSPVRYSIDRNTDLERYFNIDANSGVITTAKSLDRETNAVHNITVLAMESQNPAQIGRGYVAITILDINDNAPEF

SEQ ID NO: 13 - protein, 110 aa, Homo sapiens
RSKRGWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEF

SEQ ID NO: 14 - protein, 110 aa, Homo sapiens
RVKRGWVWNQFFVLEEYVGSEPQYVGKLHSDLDKGEGTVKYTLSGDGAGTVFTIDETTGDIHAIRSLDREEKPFYTLRAQAVDIETRKPLEPESEFIIKVQDINDNEPKF

SEQ ID NO: 15 - protein, 109 aa, Homo sapiens
LDGPYVATVPEMSPVGAYVLQVKATDADDPTYGNSARVVYSILQGQPYFSIDPKTGVIRTALPNMDREVKEQYQVLIQAKDMGGQLGGLAGTTIVNITLTDVNDNPPRF

SEQ ID NO: 16 - protein, 110 aa, Homo sapiens
RPKRGWVWNQFFVLEEHMGPDPQYVGKLHSNSDKGDGSVKYILTGEGAGTIFIIDDTTGDIHSTKSLDREQKTHYVLHAQAIDRRTNKPLEPESEFIIKVQDINDNAPKF

SEQ ID NO: 17 - protein, 109 aa, Homo sapiens
TDGPYIVTVPEMSDMGTSVLQVTATDADDPTYGNSARVVYSILQGQPYFSVDPKTGVIRTALHNMDREAREHYSVVIQAKDMAGQVGGLSGSTTVNITLTDVNDNPPRF

SEQ ID NO: 18 - protein, 105 aa, Homo sapiens
SMPSYLMEVYENAKIGTVVGTVLAQDPDSTNSLVRYFINYNVEDDRFFNIDANTGTIRTTKVLDREETPWYNITVTASEIDNPDLLSHVTVGIRVLDVNDNPPEL

SEQ ID NO: 19 - protein, 111 aa, Homo sapiens
RVRRAWVIPPISVSENHKRLPYPLVQIKSDKQQLGSVIYSIQGPGVDEEPRGVFSIDKFTGKVFLNAMLDREKTDRFRLRAFALDLGGSTLEDPTDLEIVVVDQNDNRPAF

SEQ ID NO: 20 - protein, 108 aa, Homo sapiens
LQEAFTGRVLEGAVPGTYVTRAEATDADDPETDNAALRFSILQQGSPELFSIDELTGEIRTVQVGLDREVVAVYNLTLQVADMSGDGLTATASAIITLDDINDNAPEF

SEQ ID NO: 21 - protein, 111 aa, Homo sapiens
RQKRSIVVSPILIPENQRQPFPRDVGKVVDSDRPERSKFRLTGKGVDQEPKGIFRINENTGSVSVTRTLDREVIAVYQLFVETTDVNGKTLEGPVPLEVIVIDQNDNRPIF

SEQ ID NO: 22 - protein, 110 aa, Rattus norvegicus
RVKRGWVWNQFFVVEEYTGTEPLYVGKIHSDSDEGDGTIKYTISGEGAGTIFLIDELTGDIHATERLDREQKTFYTLRAQARDRATNRLLEPESEFIIKVQDINDSEPRF

SEQ ID NO: 23 - protein, 109 aa, Rattus norvegicus
LHGPYIGSVAELSPTGTSVMQVMASDADDPTYGSSARLVYSVLDGEHHFTVDPKTGVIRTAVPDLDRESQERYEVVIQATDMAGQLGGLSGSTTVTIVVTDVNDNPPRF

SEQ ID NO: 24 - protein, 105 aa, Rattus norvegicus
RPPSGLLEVQEDAQVGSLVGVVTARDPDAANRPVRYAIDRDSDLEQIFDIDADTGAIVTGKGLDRETAGWHNITVLAMEADNHAQLSRASLRIRILDVNDNPPEL

SEQ ID NO: 25 - protein, 117 aa, Homo sapiens
LQSKYEGSVRQNSRPGKPFLYVNATDLDDPATPNGQLYYQIVIQLPMINNVMYFQINNKTGAISLTREGSQELNPAKNPYNLVISVKDMGGQSENSFSDTTSVDIIVTENIWKAPAP

SEQ ID NO: 26 - protein, 108 aa, Homo sapiens
NQSLYRARVPGGCTSGTRVVQVLATDLDEGPNGEIIYSFGSHNRAGVRQLFALDLVTGMLTIKGRLDFEDTKLHEIYIQAKDKGANPEGAHCKVLVEVVDVNDNAPEI

SEQ ID NO: 27 - protein, 110 aa, Homo sapiens
SQSSYDVYIEENNLPGAPILNLSVWDPDAPQNARLSFFLLEQGAETGLVGRYFTINRDNGIVSSLVPLDYEDRREFELTAHISDGGTPVLATNISVNIFVTDRNDNAPQV

SEQ ID NO: 28 - protein, 108 aa, Homo sapiens
EAPSYLVELPENTPLGTVVIDLNATDADEGPNGEVLYSFSSYVPDRVRELFSIDPKTGLIRVKGNLDYEENGMLEIDVQARDLGPNLIPAHCKVTVKLIDRNDNAPSI

SEQ ID NO: 29 - protein, 89 aa, Homo sapiens
VLPTLQNDTAELQVPRNAGLGYLVSTVRALDSDFGESGRLTYEIVDGNDDHLFEIDPSSGEIRTLHPFWEDVTPVVELVVKVTDHGKPT

SEQ ID NO: 30 - protein, 112 aa, Homo sapiens
RQKREWIKFAAACREGEDNSKRNPIAKIHSDCAANQQVTYRISGVGIDQPPYGIFVINQKTGEINITSIVDREVTPFFIIYCRALNSMGQDLERPLELRVRVLDINDNPPVF

SEQ ID NO: 31 - protein, 112 aa, Homo sapiens
SMATFAGQIEENSNANTLVMILNATDADEPNNLNSKIAFKIIRQEPSDSPMFIINRNTGEIRTMNNFLDREQYGQYALAVRGSDRDGGADGMSAECECNIKILDVNDNIPYM

SEQ ID NO: 32 - protein, 113 aa, Homo sapiens
TQDVFVGSVEELSAAHTLVMKINATDADEPNTLNSKISYRIVSLEPAYPPVFYLNKDTGEIYTTSVTLDREEHSSYTLTVEARDGNGEVTDKPVKQAQVQIRILDVNDNIPVV

SEQ ID NO: 33 - protein, 107 aa, Homo sapiens
RWAPIPASLMENSLGPFPQHVQQIQSDAAQNYTIFYSISGPGVDKEPFNLFYIEKDTGDIFCTRSIDREKYEQFALYGYATTADGYAPEYPLPLIIKIEDDNDNAPY

SEQ ID NO: 34 - protein, 107 aa, Homo sapiens
RWAPIPCSMLENSLGPFPLFLQQVQSDTAQNYTIYYSIRGPGVDQEPRNLFYVERDTGNLYCTRPVDREQYESFEIIAFATTPDGYTPELPLPLIIKIEDENDNYPI

SEQ ID NO: 35 - protein, 107 aa, Homo sapiens
RWAPIPCSMQENSLGPFPLFLQQVESDAAQNYTVFYSISGRGVDKEPLNLFYIERDTGNLFCTRPVDREEYDVFDLIAYASTADGYSADLPLPLPIRVEDENDNHPV

SEQ ID NO: 36 - protein, 107 aa, Homo sapiens; identical to SEQ ID NO: 35

SEQ ID NO: 37 - protein, 108 aa, Mus musculus
DRSLYTVKLPENVPNGTLVVKVNASDLDEGVNGDIMYSFSTDISPNVKYKFHIDPVSGEIIVKGYIDFEECKSYEILIEGIDKGQLPLSGHCKVIVQVEDINDNVPEL

SEQ ID NO: 38 - protein, 108 aa, Mus musculus
QHPEYEVRILENSDNGTTVIRLNASDKDEGTNSAISYSFNRLVPPKTLEQFSIDADTGEIITQGNLDFEQVDVYKIHVDATDKGHPPMVGHCTVLVKVLDENDNVPQI

SEQ ID NO: 39 - protein, 108 aa, Mus musculus
DRAIYRVKLVENARNGTVVIRLNASDLDEGSNGQILYSFAADVSPKTEATFHIDSVSGEIKVNGKIDFEETNLWKIQAEAVDKGSPPMFGHCTILIEVLDINDNAPKI

SEQ ID NO: 40 - protein, 108 aa, Mus musculus
DRFVYKVKVLEDALNGTLVINLNATDPDEGINGDIIYSFRRPVSPAVVHAFNIDSNSGEVRTKGLLDFEEIKLYEIPVEAVDKGNIPMTGHCTLLVELLDVNDNAPEV

SEQ ID NO: 41 - protein, 108 aa, Mus musculus
DKSIYNVRLLENTPNGTLVIKLNASDADEGINKEILYFFSNLVLDDVKSKFTIDSSSGEIKVKGELDYEDCKVYEINIDAVDRSAFPLAGHCKIIVKLVDVNDNVPEM

SEQ ID NO: 42 - protein, 107 aa, Mus musculus
DHLEYKVRIMENAAKETLVITLNATDLDEGANGQLVYSLMSIKPTGRHLFTLDEKNGELRVNGTLDYEENKLYEIEVLATDKGTPPMVGHCVVLVEILDTNDNSPEV

SEQ ID NO: 43 - protein, 108 aa, Mus musculus
DRSVYEVKMYENQENKTLVIWLNATDSDEGINKEVEYSFSSLASSIIRQKFLINEKTGEIKINGAIDFEESNNYEIHVDATDKGYPPMVAHCTVLVEILDENDNAPEI

SEQ ID NO: 44 - protein, 108 aa, Homo sapien
EWIKFAAACREGEDNSKRNPIAKIHSDCAANQQVTYRISGVGIDQPPYGIFVINQKTGEINITSIVDREVTPFFIIYCRALNSMGQDLERPLELRVRVLDINDNPPVF

SEQ ID NO: 45 - protein, 108 aa, Bos Torus
EWIKFAAACREGEDNSKRNPIAKIHSDCAANQQVTYRISGVGIDQPPYGIFVINQKTGEINITSIVDREVTPFFIIYCRALNSLGQDLEKPLELRVRVLDINDNPPVF

SEQ ID NO: 46 - protein, 110 aa, Homo sapien
AWITAPVALREGEDLSKKNPIAKIHSDLAEERGLKITYKYTGKGITEPPFGIFVFNKDTGELNVTSILDREETPFFLLTGYALDARGNNVEKPLELRIKVLDINDNEPVF

SEQ ID NO: 47 - protein, 108 aa, Homo sapiens
EWVKFAKPCREGEDNSKRNPIAKITSDYQATQKITYRISGVGIDQPPFGIFVVDKNTGDINITAIVDREETPSFLITCRALNAQGLDVEKPLILTVKILDINDNPPVF

SEQ ID NO: 48 - protein, 108 aa, Mus musculus
EWVKFAKPCREREDNSRRNPIAKITSDFQKNQKITYRISGVGIDQPPFGIFVVDPNNGDINITAIVDREETPSFLITCRALNALGQDVERPLILTVKILDVNDNPPIF

SEQ ID NO: 49 - protein, 108 aa, Homo sapiens
RWAPIPASLMENSLGPFPQHVQQIQSDAAQNYTIFYSISGPGVDKEPFNLFYIEKDTGDIFCTRSIDREKYEQFALYGYATTADGYAPEYPLPLIIKIEDDNDNAPYF

SEQ ID NO: 50 - protein, 108 aa, Mus musculus
RWAPIPCSLMENSLGPFPQHIQQIQSDAAQNYTIFYSISGPGDDKEPYNLFYIEKDTGDIYCTRSIDREQYDQFLVYGYATTADGYAPDYPLPLLFKVEDDNDNAPYF

SEQ ID NO: 51 - protein, 108 aa, Bos torus
RWAPIPCSLMENSLGPFPQHVQQVQSDAAQNYTIFYSISGPGVDKEPFNLFFIEKDTGDIFCTRSIDREQYQEFPIYAYATTADGYAPEYPLPLVFKVEDDNDNAPYF

SEQ ID NO: 52 - protein, 108 aa, Homo sapiens
RWAPIPCSMLENSLGPFPLFLQQVQSDTAQNYTIYYSIRGPGVDQEPRNLFYVERDTGNLYCTRPVDREQYESFEIIAFATTPDGYTPELPLPLIIKIEDENDNYPIF

SEQ ID NO: 53 - protein, 108 aa, Canis familaris
RWAPIPCSMQENSLGPFPLFLQQIQSDTAQNYTIFYSIRGPGVDREPKNLFYVERDTGNLFCTRPVDREEYESFELIAFATTPDGYTPELPLPLVIRIEDENDNYPIF

SEQ ID NO: 54 - protein, 108 aa, Homo sapiens
RWAPIPCSMQENSLGPFPLFLQQVESDAAQNYTVFYSISGRGVDKEPLNLFYIERDTGNLFCTRPVDREEYDVFDLIAYASTADGYSADLPLPLPIRVEDENDNHPVF

SEQ ID NO: 55 - protein, 108 aa, Mus musculus
RWAPIPCSMQENSLGPFPLFLQQVQSDAAQNYTVFYSISGRGADQEPLNWFFIERDTGNLYCTRPVDREEYDVFDLIAYASTADGYSADLPLPLPIKIEDENDNYPLF

SEQ ID NO: 56 - protein, 108 aa, Bos Torus
RWAPIPCSMQENSLGPFPLFLQQVQSDAAQNYTIFYSISGRGVDKEPLNLFFIERDTGNLYCTQPVDREEYDVFDLIAYASTADGYSADFPLPLPIRVEDENDNHPIF

SEQ ID NO: 57 - protein, 108 aa, Homo sapiens; identical to SEQ ID NO: 54

SEQ ID NO: 58 - protein, 5 aa, Artificial Sequence
  Representative cyclic peptide modulating agent
CNRNC

SEQ ID NO: 59 - protein, 5 aa, Artificial Sequence
  Representative cyclic peptide modulating agent
CEKDC

SEQ ID NO: 60 - protein, 5 aa, Artificial Sequence
  Representative cyclic peptide modulating agent
CERDC

SEQ ID NO: 61 - protein, 5 aa, Artificial Sequence
  Representative cyclic peptide modulating agent
CNKDC

SEQ ID NO: 62 - protein, 5 aa, Artificial Sequence
  Representative cyclic peptide modulating agent
CNQKC

SEQ ID NO: 63 - protein, 4 aa, Artificial Sequence
  Modulating agent comprising desomglein cell adhesion recognition sequence
NQKT

SEQ ID NO: 64 - protein, 5 aa, Artificial Sequence
  Modulating agent comprising desomglein cell adhesion recognition sequence
NQKTG

SEQ ID NO: 65 - protein, 4 aa, Artificial Sequence
  Modulating agent comprising desomglein cell adhesion recognition sequence
INQK

SEQ ID NO: 66 - protein, 5 aa, Artificial Sequence
  Modulating agent comprising desomglein cell adhesion recognition sequence
INQKT

SEQ ID NO: 67 - protein, 6 aa, Artificial Sequence
  Modulating agent comprising desomglein cell adhesion recognition sequence
INQKTG

SEQ ID NO: 68 - protein, 5 aa, Artificial Sequence
  Modulating agent comprising desomglein cell adhesion recognition sequence
VINQK

SEQ ID NO: 69 - protein, 6 aa, Artificial Sequence
  Modulating agent comprising desomglein cell adhesion recognition sequence
VINQKT

SEQ ID NO: 70 - protein, 7 aa, Artificial Sequence
  Modulating agent comprising desomglein cell adhesion recognition sequence
VINQKTG

SEQ ID NO: 71 - protein, 6 aa, Artificial Sequence
  Modulating agent comprising desomglein cell adhesion recognition sequence
FVINQK

SEQ ID NO: 72 - protein, 7 aa, Artificial Sequence
  Modulating agent comprising desomglein cell adhesion recognition sequence
FVINQKT

SEQ ID NO: 73 - protein, 8 aa, Artificial Sequence
  Modulating agent comprising desomglein cell adhesion recognition sequence
FVINQKTG

SEQ ID NO: 74 - protein, 7 aa, Artificial Sequence
  Modulating agent comprising desomglein cell adhesion recognition sequence
IFVINQK

SEQ ID NO: 75 - protein, 8 aa, Artificial Sequence
  Modulating agent comprising desomglein cell adhesion recognition sequence
IFVINQKT

SEQ ID NO: 76 - protein, 9 aa, Artificial Sequence
  Modulating agent comprising desomglein cell adhesion recognition sequence
IFVINQKTG

SEQ ID NO: 77 - protein, 4 aa, Artificial Sequence
  Modulating agent comprising desomglein cell adhesion recognition sequence
NRNT

SEQ ID NO: 78 - protein, 5 aa, Artificial Sequence
  Modulating agent comprising desomglein cell adhesion recognition sequence
NRNTG

SEQ ID NO: 79 - protein, 4 aa, Artificial Sequence
  Modulating agent comprising desomglein cell adhesion recognition sequence
INRN

SEQ ID NO: 80 - protein, 5 aa, Artificial Sequence
  Modulating agent comprising desomglein cell adhesion recognition sequence
INRNT

SEQ ID NO: 81 - protein, 6 aa, Artificial Sequence
  Modulating agent comprising desomglein cell adhesion recognition sequence
INRNTG

SEQ ID NO: 82 - protein, 5 aa, Artificial Sequence
  Modulating agent comprising desomglein cell adhesion recognition sequence
IINRN

SEQ ID NO: 83 - protein, 6 aa, Artificial Sequence
  Modulating agent comprising desomglein cell adhesion recognition sequence
IINRNT

SEQ ID NO: 84 - protein, 7 aa, Artificial Sequence
  Modulating agent comprising desomglein cell adhesion recognition sequence
IINRNTG

SEQ ID NO: 85 - protein, 6 aa, Artificial Sequence
  Modulating agent comprising desomglein cell adhesion recognition sequence
FIINRN

SEQ ID NO: 86 - protein, 7 aa, Artificial Sequence
  Modulating agent comprising desomglein cell adhesion recognition sequence
FIINRNT

SEQ ID NO: 87 - protein, 8 aa, Artificial Sequence
  Modulating agent comprising desomglein cell adhesion recognition sequence
FIINRNTG

SEQ ID NO: 88 - protein, 7 aa, Artificial Sequence
  Modulating agent comprising desomglein cell adhesion recognition sequence
MFIINRN

SEQ ID NO: 89 - protein, 8 aa, Artificial Sequence
  Modulating agent comprising desomglein cell adhesion recognition sequence
MFIINRNT

SEQ ID NO: 90 - protein, 9 aa, Artificial Sequence
  Modulating agent comprising desomglein cell adhesion recognition sequence
MFIINRNTG

SEQ ID NO: 91 - protein, 4 aa, Artificial Sequence
  Modulating agent comprising desomglein cell adhesion recognition sequence
NKDT

SEQ ID NO: 92 - protein, 5 aa, Artificial Sequence
  Modulating agent comprising desomglein cell adhesion recognition sequence
NKDTG

SEQ ID NO: 93 - protein, 4 aa, Artificial Sequence
  Modulating agent comprising desomglein cell adhesion recognition sequence
LNKD

SEQ ID NO: 94 - protein, 5 aa, Artificial Sequence
  Modulating agent comprising desomglein cell adhesion recognition sequence
LNKDT

SEQ ID NO: 95 - protein, 6 aa, Artificial Sequence
  Modulating agent comprising desomglein cell adhesion recognition sequence
LNKDTG

SEQ ID NO: 96 - protein, 5 aa, Artificial Sequence
  Modulating agent comprising desomglein cell adhesion recognition sequence
YLNKD

SEQ ID NO: 97 - protein, 6 aa, Artificial Sequence
  Modulating agent comprising desomglein cell adhesion recognition sequence
YLNKDT

SEQ ID NO: 98 - protein, 7 aa, Artificial Sequence
  Modulating agent comprising desomglein cell adhesion recognition sequence
YLNKDTG

SEQ ID NO: 99 - protein, 6 aa, Artificial Sequence
  Modulating agent comprising desomglein cell adhesion recognition sequence
FYLNKD

SEQ ID NO: 100 - protein, 7 aa, Artificial Sequence
  Modulating agent comprising desomglein cell adhesion recognition sequence
FYLNKDT

SEQ ID NO: 101 - protein, 8 aa, Artificial Sequence
  Modulating agent comprising desomglein cell adhesion recognition sequence
FYLNKDTG

SEQ ID NO: 102 - protein, 7 aa, Artificial Sequence
  Modulating agent comprising desomglein cell adhesion recognition sequence
VFYLNKD

SEQ ID NO: 103 - protein, 8 aa, Artificial Sequence
  Modulating agent comprising desomglein cell adhesion recognition sequence
VFYLNKDT

SEQ ID NO: 104 - protein, 9 aa, Artificial Sequence
  Modulating agent comprising desomglein cell adhesion recognition sequence
VFYLNKDTG

SEQ ID NO: 105 - protein, 9 aa, Artificial Sequence
  Modulating agent comprising desomglein cell adhesion recognition sequence
  ACETYLATION (1)...(1)
  AMIDATION (9)...(9)
IFVINQKTG

SEQ ID NO: 106 - protein, 9 aa, Artificial Sequence
  Modulating agent comprising desomglein cell adhesion recognition sequence
  ACETYLATION (1)...(1)
  AMIDATION (9)...(9)
MFIINRNTG

SEQ ID NO: 107 - protein, 9 aa, Artificial Sequence
  Modulating agent comprising desomglein cell adhesion recognition sequence
  ACETYLATION (1)...(1)
  AMIDATION (9)...(9)
VFYLNKDTG

SEQ ID NO: 108 - protein, 4 aa, Artificial Sequence
  Modulating agent comprising desmocollin cell adhesion recognition sequence
EKDT

SEQ ID NO: 109 - protein, 5 aa, Artificial Sequence
  Modulating agent comprising desmocollin cell adhesion recognition sequence
EKDTG

SEQ ID NO: 110 - protein, 4 aa, Artificial Sequence
  Modulating agent comprising desmocollin cell adhesion recognition sequence
IEKD

SEQ ID NO: 111 - protein, 5 aa, Artificial Sequence
  Modulating agent comprising desmocollin cell adhesion recognition sequence
IEKDT

SEQ ID NO: 112 - protein, 6 aa, Artificial Sequence
  Modulating agent comprising desmocollin cell adhesion recognition sequence
IEKDTG

SEQ ID NO: 113 - protein, 5 aa, Artificial Sequence
  Modulating agent comprising desmocollin cell adhesion recognition sequence
YIEKD

SEQ ID NO: 114 - protein, 6 aa, Artificial Sequence
  Modulating agent comprising desmocollin cell adhesion recognition sequence
YIEKDT

SEQ ID NO: 115 - protein, 7 aa, Artificial Sequence
  Modulating agent comprising desmocollin cell adhesion recognition sequence
YIEKDTG

SEQ ID NO: 116 - protein, 6 aa, Artificial Sequence
  Modulating agent comprising desmocollin cell adhesion recognition sequence
FYIEKD

SEQ ID NO: 117 - protein, 7 aa, Artificial Sequence
  Modulating agent comprising desmocollin cell adhesion recognition sequence
FYIEKDT

SEQ ID NO: 118 - protein, 8 aa, Artificial Sequence
  Modulating agent comprising desmocollin cell adhesion recognition sequence
FYIEKDTG

SEQ ID NO: 119 - protein, 7 aa, Artificial Sequence
  Modulating agent comprising desmocollin cell adhesion recognition sequence
LFYIEKD

SEQ ID NO: 120 - protein, 8 aa, Artificial Sequence
  Modulating agent comprising desmocollin cell adhesion recognition sequence
LFYIEKDT

SEQ ID NO: 121 - protein, 9 aa, Artificial Sequence
  Modulating agent comprising desmocollin cell adhesion recognition sequence
LFYIEKDTG

SEQ ID NO: 122 - protein, 4 aa, Artificial Sequence
  Modulating agent comprising desmocollin cell adhesion recognition sequence
ERDT

SEQ ID NO: 123 - protein, 5 aa, Artificial Sequence
  Modulating agent comprising desmocollin cell adhesion recognition sequence
ERDTG

SEQ ID NO: 124 - protein, 4 aa, Artificial Sequence
  Modulating agent comprising desmocollin cell adhesion recognition sequence
VERD

SEQ ID NO: 125 - protein, 5 aa, Artificial Sequence
  Modulating agent comprising desmocollin cell adhesion recognition sequence
VERDT

SEQ ID NO: 126 - protein, 6 aa, Artificial Sequence
  Modulating agent comprising desmocollin cell adhesion recognition sequence
VERDTG

SEQ ID NO: 127 - protein, 5 aa, Artificial Sequence
  Modulating agent comprising desmocollin cell adhesion recognition sequence
YVERD

SEQ ID NO: 128 - protein, 6 aa, Artificial Sequence
  Modulating agent comprising desmocollin cell adhesion recognition sequence
YVERDT

SEQ ID NO: 129 - protein, 7 aa, Artificial Sequence
  Modulating agent comprising desmocollin cell adhesion recognition sequence
YVERDTG

SEQ ID NO: 130 - protein, 6 aa, Artificial Sequence
  Modulating agent comprising desmocollin cell adhesion recognition sequence
FYVERD

SEQ ID NO: 131 - protein, 7 aa, Artificial Sequence
  Modulating agent comprising desmocollin cell adhesion recognition sequence
FYVERDT

SEQ ID NO: 132 - protein, 8 aa, Artificial Sequence
  Modulating agent comprising desmocollin cell adhesion recognition sequence
FYVERDTG

SEQ ID NO: 133 - protein, 7 aa, Artificial Sequence
  Modulating agent comprising desmocollin cell adhesion recognition sequence
LFYVERD

SEQ ID NO: 134 - protein, 8 aa, Artificial Sequence
  Modulating agent comprising desmocollin cell adhesion recognition sequence
LFYVERDT

SEQ ID NO: 135 - protein, 9 aa, Artificial Sequence
  Modulating agent comprising desmocollin cell adhesion recognition sequence
LFYVERDTG

SEQ ID NO: 136 - protein, 4 aa, Artificial Sequence
  Modulating agent comprising desmocollin cell adhesion recognition sequence
IERD

SEQ ID NO: 137 - protein, 5 aa, Artificial Sequence
  Modulating agent comprising desmocollin cell adhesion recognition sequence
IERDT

SEQ ID NO: 138 - protein, 6 aa, Artificial Sequence
  Modulating agent comprising desmocollin cell adhesion recognition sequence
IERDTG

SEQ ID NO: 139 - protein, 5 aa, Artificial Sequence
  Modulating agent comprising desmocollin cell adhesion recognition sequence
YIERD

SEQ ID NO: 140 - protein, 6 aa, Artificial Sequence
  Modulating agent comprising desmocollin cell adhesion recognition sequence
YIERDT

SEQ ID NO: 141 - protein, 7 aa, Artificial Sequence
  Modulating agent comprising desmocollin cell adhesion recognition sequence
YIERDTG

SEQ ID NO: 142 - protein, 6 aa, Artificial Sequence
  Modulating agent comprising desmocollin cell adhesion recognition sequence
FYIERD

SEQ ID NO: 143 - protein, 7 aa, Artificial Sequence
  Modulating agent comprising desmocollin cell adhesion recognition sequence
FYIERDT

SEQ ID NO: 144 - protein, 8 aa, Artificial Sequence
  Modulating agent comprising desmocollin cell adhesion recognition sequence
FYIERDTG

SEQ ID NO: 145 - protein, 7 aa, Artificial Sequence
  Modulating agent comprising desmocollin cell adhesion recognition sequence
LFYIERD

SEQ ID NO: 146 - protein, 8 aa, Artificial Sequence
  Modulating agent comprising desmocollin cell adhesion recognition sequence
LFYIERDT

SEQ ID NO: 147 - protein, 9 aa, Artificial Sequence
  Modulating agent comprising desmocollin cell adhesion recognition sequence
LFYIERDTG

SEQ ID NO: 148 - protein, 9 aa, Artificial Sequence
  Modulating agent comprising desmocollin cell adhesion recognition sequence
  ACETYLATION 1
  AMIDATION 9
LFYIEKDTG

SEQ ID NO: 149 - protein, 9 aa, Artificial Sequence
  Modulating agent comprising desmocollin cell adhesion recognition sequence
  ACETYLATION 1
  AMIDATION 9
LFYVERDTG

SEQ ID NO: 150 - protein, 9 aa, Artificial Sequence
  Modulating agent comprising desmocollin cell adhesion recognition sequence
  ACETYLATION 1
  AMIDATION 9
LFYIERDTG

SEQ ID NO: 151 - protein, 4 aa, Artificial Sequence
  Modulating agent comprising desmoglein-1 cell adhesion recognition sequence
RALN

SEQ ID NO: 152 - protein, 5 aa, Artificial Sequence
  Modulating agent comprising desmoglein-1 cell adhesion recognition sequence
RALNS

SEQ ID NO: 153 - protein, 6 aa, Artificial Sequence
  Modulating agent comprising desmoglein-1 cell adhesion recognition sequence
RALNSM

SEQ ID NO: 154 - protein, 6 aa, Artificial Sequence
  Modulating agent comprising desmoglein-1 cell adhesion recognition sequence
RALNSL

SEQ ID NO: 155 - protein, 7 aa, Artificial Sequence
  Modulating agent comprising desmoglein-1 cell adhesion recognition sequence
RALNSMG

SEQ ID NO: 156 - protein, 7 aa, Artificial Sequence
  Modulating agent comprising desmoglein-1 cell adhesion recognition sequence
RALNSLG

SEQ ID NO: 157 - protein, 4 aa, Artificial Sequence
  Modulating agent comprising desmoglein-1 cell adhesion recognition sequence
CRAL

SEQ ID NO: 158 - protein, 5 aa, Artificial Sequence
  Modulating agent comprising desmoglein-1 cell adhesion recognition sequence
CRALN

SEQ ID NO: 159 - protein, 6 aa, Artificial Sequence
  Modulating agent comprising desmoglein-1 cell adhesion recognition sequence
CRALNS

SEQ ID NO: 160 - protein, 7 aa, Artificial Sequence
  Modulating agent comprising desmoglein-1 cell adhesion recognition sequence
CRALNSM

SEQ ID NO: 161 - protein, 7 aa, Artificial Sequence
  Modulating agent comprising desmoglein-1 cell adhesion recognition sequence
CRALNSL

SEQ ID NO: 162 - protein, 8 aa, Artificial Sequence
  Modulating agent comprising desmoglein-1 cell adhesion recognition sequence
CRALNSMG

SEQ ID NO: 163 - protein, 8 aa, Artificial Sequence
  Modulating agent comprising desmoglein-1 cell adhesion recognition sequence
CRALNSLG

SEQ ID NO: 164 - protein, 5 aa, Artificial Sequence
  Modulating agent comprising desmoglein-1 cell adhesion recognition sequence
YCRAL

SEQ ID NO: 165 - protein, 6 aa, Artificial Sequence
  Modulating agent comprising desmoglein-1 cell adhesion recognition sequence
YCRALN

SEQ ID NO: 166 - protein, 7 aa, Artificial Sequence
  Modulating agent comprising desmoglein-1 cell adhesion recognition sequence
YCRALNS

SEQ ID NO: 167 - protein, 8 aa, Artificial Sequence
  Modulating agent comprising desmoglein-1 cell adhesion recognition sequence
YCRALNSM

SEQ ID NO: 168 - protein, 8 aa, Artificial Sequence
  Modulating agent comprising desmoglein-1 cell adhesion recognition sequence
YCRALNSL

SEQ ID NO: 169 - protein, 9 aa, Artificial Sequence
  Modulating agent comprising desmoglein-1 cell adhesion recognition sequence
YCRALNSMG

SEQ ID NO: 170 - protein, 9 aa, Artificial Sequence
  Modulating agent comprising desmoglein-1 cell adhesion recognition sequence
YCRALNSLG

SEQ ID NO: 171 - protein, 5 aa, Artificial Sequence
  Modulating agent comprising desmoglein-1 cell adhesion recognition sequence
IYRAL

SEQ ID NO: 172 - protein, 6 aa, Artificial Sequence
  Modulating agent comprising desmoglein-1 cell adhesion recognition sequence
IYRALN

SEQ ID NO: 173 - protein, 7 aa, Artificial Sequence
  Modulating agent comprising desmoglein-1 cell adhesion recognition sequence
IYRALNS

SEQ ID NO: 174 - protein, 8 aa, Artificial Sequence
  Modulating agent comprising desmoglein-1 cell adhesion recognition sequence
IYRALNSM

SEQ ID NO: 175 - protein, 8 aa, Artificial Sequence
  Modulating agent comprising desmoglein-1 cell adhesion recognition sequence
IYRALNSL

SEQ ID NO: 176 - protein, 9 aa, Artificial Sequence
  Modulating agent comprising desmoglein-1 cell adhesion recognition sequence
IYRALNSMG

SEQ ID NO: 177 - protein, 9 aa, Artificial Sequence
  Modulating agent comprising desmoglein-1 cell adhesion recognition sequence
IYRALNSLG

SEQ ID NO: 178 - protein, 9 aa, Artificial Sequence
  Modulating agent comprising desmoglein-1 cell adhesion recognition sequence
  ACETYLATION 1
  AMIDATION 9
IYRALNSMG

SEQ ID NO: 179 - protein, 9 aa, Artificial Sequence
  Modulating agent comprising desmoglein-1 cell adhesion recognition sequence
  ACETYLATION 1
  AMIDATION 9
IYRALNSLG

SEQ ID NO: 180 - protein, 4 aa, Artificial Sequence
  Modulating agent comprising desmoglein-2 cell adhesion recognition sequence
YALD

SEQ ID NO: 181 - protein, 5 aa, Artificial Sequence
  Modulating agent comprising desmoglein-2 cell adhesion recognition sequence
YALDA

SEQ ID NO: 182 - protein, 6 aa, Artificial Sequence
  Modulating agent comprising desmoglein-2 cell adhesion recognition sequence
YALDAR

SEQ ID NO: 183 - protein, 7 aa, Artificial Sequence
  Modulating agent comprising desmoglein-2 cell adhesion recognition sequence
YALDARG

SEQ ID NO: 184 - protein, 4 aa, Artificial Sequence
  Modulating agent comprising desmoglein-2 cell adhesion recognition sequence
GYAL

SEQ ID NO: 185 - protein, 5 aa, Artificial Sequence
  Modulating agent comprising desmoglein-2 cell adhesion recognition sequence
GYALD

SEQ ID NO: 186 - protein, 6 aa, Artificial Sequence
  Modulating agent comprising desmoglein-2 cell adhesion recognition sequence
GYALDA

SEQ ID NO: 187 - protein, 7 aa, Artificial Sequence
  Modulating agent comprising desmoglein-2 cell adhesion recognition sequence
GYALDAR

SEQ ID NO: 188 - protein, 8 aa, Artificial Sequence
  Modulating agent comprising desmoglein-2 cell adhesion recognition sequence
GYALDARG

SEQ ID NO: 189 - protein, 5 aa, Artificial Sequence
  Modulating agent comprising desmoglein-2 cell adhesion recognition sequence
TGYAL

SEQ ID NO: 190 - protein, 6 aa, Artificial Sequence
  Modulating agent comprising desmoglein-2 cell adhesion recognition sequence
TGYALD

SEQ ID NO: 191 - protein, 7 aa, Artificial Sequence
  Modulating agent comprising desmoglein-2 cell adhesion recognition sequence
TGYALDA

SEQ ID NO: 192 - protein, 8 aa, Artificial Sequence
  Modulating agent comprising desmoglein-2 cell adhesion recognition sequence
TGYALDAR

SEQ ID NO: 193 - protein, 9 aa, Artificial Sequence
  Modulating agent comprising desmoglein-2 cell adhesion recognition sequence
TGYALDARG

SEQ ID NO: 194 - protein, 6 aa, Artificial Sequence
  Modulating agent comprising desmoglein-2 cell adhesion recognition sequence
LTGYAL

SEQ ID NO: 195 - protein, 7 aa, Artificial Sequence
  Modulating agent comprising desmoglein-2 cell adhesion recognition sequence
LTGYALD

SEQ ID NO: 196 - protein, 8 aa, Artificial Sequence
  Modulating agent comprising desmoglein-2 cell adhesion recognition sequence
LTGYALDA

SEQ ID NO: 197 - protein, 9 aa, Artificial Sequence
  Modulating agent comprising desmoglein-2 cell adhesion recognition sequence
LTGYALDAR

SEQ ID NO: 198 - protein, 10 aa, Artificial Sequence
  Modulating agent comprising desmoglein-2 cell adhesion recognition sequence
LTGYALDARG

SEQ ID NO: 199 - protein, 10 aa, Artificial Sequence
  Modulating agent comprising desmoglein-2 cell adhesion recognition sequence
  ACETYLATION 1
  AMIDATION 10
LTGYALDARG

SEQ ID NO: 200 - protein, 5 aa, Artificial Sequence
  Modulating agent comprising desmoglein-3 cell adhesion recognition sequence
RALNA

SEQ ID NO: 201 - protein, 6 aa, Artificial Sequence
  Modulating agent comprising desmoglein-3 cell adhesion recognition sequence
RALNAQ

SEQ ID NO: 202 - protein, 6 aa, Artificial Sequence
  Modulating agent comprising desmoglein-3 cell adhesion recognition sequence
RALNAL

SEQ ID NO: 203 - protein, 7 aa, Artificial Sequence
  Modulating agent comprising desmoglein-3 cell adhesion recognition sequence
RALNAQG

SEQ ID NO: 204 - protein, 7 aa, Artificial Sequence
  Modulating agent comprising desmoglein-3 cell adhesion recognition sequence
RALNALG

SEQ ID NO: 205 - protein, 6 aa, Artificial Sequence
  Modulating agent comprising desmoglein-3 cell adhesion recognition sequence
CRALNA

SEQ ID NO: 206 - protein, 7 aa, Artificial Sequence
  Modulating agent comprising desmoglein-3 cell adhesion recognition sequence
CRALNAQ

SEQ ID NO: 207 - protein, 7 aa, Artificial Sequence
  Modulating agent comprising desmoglein-3 cell adhesion recognition sequence
CRALNAL

SEQ ID NO: 208 - protein, 8 aa, Artificial Sequence
  Modulating agent comprising desmoglein-3 cell adhesion recognition sequence
CRALNAQG

SEQ ID NO: 209 - protein, 8 aa, Artificial Sequence
  Modulating agent comprising desmoglein-3 cell adhesion recognition sequence
CRALNALG

SEQ ID NO: 210 - protein, 5 aa, Artificial Sequence
  Modulating agent comprising desmoglein-3 cell adhesion recognition sequence
TCRAL

SEQ ID NO: 211 - protein, 6 aa, Artificial Sequence
  Modulating agent comprising desmoglein-3 cell adhesion recognition sequence
TCRALN

SEQ ID NO: 212 - protein, 7 aa, Artificial Sequence
  Modulating agent comprising desmoglein-3 cell adhesion recognition sequence
TCRALNA

SEQ ID NO: 213 - protein, 8 aa, Artificial Sequence
  Modulating agent comprising desmoglein-3 cell adhesion recognition sequence
TCRALNAQ

SEQ ID NO: 214 - protein, 8 aa, Artificial Sequence
  Modulating agent comprising desmoglein-3 cell adhesion recognition sequence
TCRALNAL

SEQ ID NO: 215 - protein, 9 aa, Artificial Sequence
  Modulating agent comprising desmoglein-3 cell adhesion recognition sequence
TCRALNAQG

SEQ ID NO: 216 - protein, 9 aa, Artificial Sequence
  Modulating agent comprising desmoglein-3 cell adhesion recognition sequence
TCRALNALG

SEQ ID NO: 217 - protein, 6 aa, Artificial Sequence
  Modulating agent comprising desmoglein-3 cell adhesion recognition sequence
ITCRAL

SEQ ID NO: 218 - protein, 7 aa, Artificial Sequence
  Modulating agent comprising desmoglein-3 cell adhesion recognition sequence
ITCRALN

SEQ ID NO: 219 - protein, 8 aa, Artificial Sequence
  Modulating agent comprising desmoglein-3 cell adhesion recognition sequence
ITCRALNA

SEQ ID NO: 220 - protein, 9 aa, Artificial Sequence
  Modulating agent comprising desmoglein-3 cell adhesion recognition sequence
ITCRALNAQ

SEQ ID NO: 221 - protein, 9 aa, Artificial Sequence
  Modulating agent comprising desmoglein-3 cell adhesion recognition sequence
ITCRALNAL

SEQ ID NO: 222 - protein, 10 aa, Artificial Sequence
  Modulating agent comprising desmoglein-3 cell adhesion recognition sequence
ITCRALNAQG

SEQ ID NO: 223 - protein, 10 aa, Artificial Sequence
  Modulating agent comprising desmoglein-3 cell adhesion recognition sequence
ITCRALNALG

SEQ ID NO: 224 - protein, 10 aa, Artificial Sequence
  Modulating agent comprising desmoglein-3 cell adhesion recognition sequence
  ACETYLATION 1
  AMIDATION 10
ITCRALNAQG

SEQ ID NO: 225 - protein, 10 aa, Artificial Sequence
  Modulating agent comprising desmoglein-3 cell adhesion recognition sequence
  ACETYLATION 1
  AMIDATION 10
ITCRALNALG

SEQ ID NO: 226 - protein, 4 aa, Artificial Sequence
  Modulating agent comprising desmocollin-1 cell adhesion recognition sequence
YATT

SEQ ID NO: 227 - protein, 5 aa, Artificial Sequence
  Modulating agent comprising desmocollin-1 cell adhesion recognition sequence
YATTA

SEQ ID NO: 228 - protein, 6 aa, Artificial Sequence
  Modulating agent comprising desmocollin-1 cell adhesion recognition sequence
YATTAD

SEQ ID NO: 229 - protein, 7 aa, Artificial Sequence
  Modulating agent comprising desmocollin-1 cell adhesion recognition sequence
YATTADG

SEQ ID NO: 230 - protein, 4 aa, Artificial Sequence
  Modulating agent comprising desmocollin-1 cell adhesion recognition sequence
GYAT

SEQ ID NO: 231 - protein, 5 aa, Artificial Sequence
  Modulating agent comprising desmocollin-1 cell adhesion recognition sequence
GYATT

SEQ ID NO: 232 - protein, 6 aa, Artificial Sequence
  Modulating agent comprising desmocollin-1 cell adhesion recognition sequence
GYATTA

SEQ ID NO: 233 - protein, 7 aa, Artificial Sequence
  Modulating agent comprising desmocollin-1 cell adhesion recognition sequence
GYATTAD

SEQ ID NO: 234 - protein, 8 aa, Artificial Sequence
  Modulating agent comprising desmocollin-1 cell adhesion recognition sequence
GYATTADG

SEQ ID NO: 235 - protein, 4 aa, Artificial Sequence
  Modulating agent comprising desmocollin-1 cell adhesion recognition sequence
AYAT

SEQ ID NO: 236 - protein, 5 aa, Artificial Sequence
  Modulating agent comprising desmocollin-1 cell adhesion recognition sequence
AYATT

SEQ ID NO: 237 - protein, 6 aa, Artificial Sequence
  Modulating agent comprising desmocollin-1 cell adhesion recognition sequence
AYATTA

SEQ ID NO: 238 - protein, 7 aa, Artificial Sequence
  Modulating agent comprising desmocollin-1 cell adhesion recognition sequence
AYATTAD

SEQ ID NO: 239 - protein, 8 aa, Artificial Sequence
  Modulating agent comprising desmocollin-1 cell adhesion recognition sequence
AYATTADG

SEQ ID NO: 240 - protein, 5 aa, Artificial Sequence
  Modulating agent comprising desmocollin-1 cell adhesion recognition sequence
YGYAT

SEQ ID NO: 241 - protein, 6 aa, Artificial Sequence
  Modulating agent comprising desmocollin-1 cell adhesion recognition sequence
YGYATT

SEQ ID NO: 242 - protein, 7 aa, Artificial Sequence
  Modulating agent comprising desmocollin-1 cell adhesion recognition sequence
YGYATTA

SEQ ID NO: 243 - protein, 8 aa, Artificial Sequence
  Modulating agent comprising desmocollin-1 cell adhesion recognition sequence
YGYATTAD

SEQ ID NO: 244 - protein, 9 aa, Artificial Sequence
  Modulating agent comprising desmocollin-1 cell adhesion recognition sequence
YGYATTADG

SEQ ID NO: 245 - protein, 5 aa, Artificial Sequence
  Modulating agent comprising desmocollin-1 cell adhesion recognition sequence
YAYAT

SEQ ID NO: 246 - protein, 6 aa, Artificial Sequence
  Modulating agent comprising desmocollin-1 cell adhesion recognition sequence
YAYATT

SEQ ID NO: 247 - protein, 7 aa, Artificial Sequence
  Modulating agent comprising desmocollin-1 cell adhesion recognition sequence
YAYATTA

SEQ ID NO: 248 - protein, 8 aa, Artificial Sequence
  Modulating agent comprising desmocollin-1 cell adhesion recognition sequence
YAYATTAD

SEQ ID NO: 249 - protein, 9 aa, Artificial Sequence
  Modulating agent comprising desmocollin-1 cell adhesion recognition sequence
YAYATTADG

SEQ ID NO: 250 - protein, 6 aa, Artificial Sequence
  Modulating agent comprising desmocollin-1 cell adhesion recognition sequence
LYGYAT

SEQ ID NO: 251 - protein, 7 aa, Artificial Sequence
  Modulating agent comprising desmocollin-1 cell adhesion recognition sequence
LYGYATT

SEQ ID NO: 252 - protein, 8 aa, Artificial Sequence
  Modulating agent comprising desmocollin-1 cell adhesion recognition sequence
LYGYATTA

SEQ ID NO: 253 - protein, 9 aa, Artificial Sequence
  Modulating agent comprising desmocollin-1 cell adhesion recognition sequence
LYGYATTAD

SEQ ID NO: 254 - protein, 10 aa, Artificial Sequence
  Modulating agent comprising desmocollin-1 cell adhesion recognition sequence
LYGYATTADG

SEQ ID NO: 255 - protein, 6 aa, Artificial Sequence
  Modulating agent comprising desmocollin-1 cell adhesion recognition sequence
LYAYAT

SEQ ID NO: 256 - protein, 7 aa, Artificial Sequence
  Modulating agent comprising desmocollin-1 cell adhesion recognition sequence
LYAYATT

SEQ ID NO: 257 - protein, 8 aa, Artificial Sequence
  Modulating agent comprising desmocollin-1 cell adhesion recognition sequence
LYAYATTA

SEQ ID NO: 258 - protein, 9 aa, Artificial Sequence
  Modulating agent comprising desmocollin-1 cell adhesion recognition sequence
LYAYATTAD

SEQ ID NO: 259 - protein, 10 aa, Artificial Sequence
  Modulating agent comprising desmocollin-1 cell adhesion recognition sequence
LYAYATTADG

SEQ ID NO: 260 - protein, 6 aa, Artificial Sequence
  Modulating agent comprising desmocollin-1 cell adhesion recognition sequence
VYGYAT

SEQ ID NO: 261 - protein, 7 aa, Artificial Sequence
  Modulating agent comprising desmocollin-1 cell adhesion recognition sequence
VYGYATT

SEQ ID NO: 262 - protein, 8 aa, Artificial Sequence
  Modulating agent comprising desmocollin-1 cell adhesion recognition sequence
VYGYATTA

SEQ ID NO: 263 - protein, 9 aa, Artificial Sequence
  Modulating agent comprising desmocollin-1 cell adhesion recognition sequence
VYGYATTAD

SEQ ID NO: 264 - protein, 10 aa, Artificial Sequence
  Modulating agent comprising desmocollin-1 cell adhesion recognition sequence
VYGYATTADG

SEQ ID NO: 265 - protein, 6 aa, Artificial Sequence
  Modulating agent comprising desmocollin-1 cell adhesion recognition sequence
VYAYAT

SEQ ID NO: 266 - protein, 7 aa, Artificial Sequence
  Modulating agent comprising desmocollin-1 cell adhesion recognition sequence
VYAYATT

SEQ ID NO: 267 - protein, 8 aa, Artificial Sequence
  Modulating agent comprising desmocollin-1 cell adhesion recognition sequence
VYAYATTA

SEQ ID NO: 268 - protein, 9 aa, Artificial Sequence
  Modulating agent comprising desmocollin-1 cell adhesion recognition sequence
VYAYATTAD

SEQ ID NO: 269 - protein, 10 aa, Artificial Sequence
  Modulating agent comprising desmocollin-1 cell adhesion recognition sequence
VYAYATTADG

SEQ ID NO: 270 - protein, 6 aa, Artificial Sequence
  Modulating agent comprising desmocollin-1 cell adhesion recognition sequence
IYGYAT

SEQ ID NO: 271 - protein, 7 aa, Artificial Sequence
  Modulating agent comprising desmocollin-1 cell adhesion recognition sequence
IYGYATT

SEQ ID NO: 272 - protein, 8 aa, Artificial Sequence
  Modulating agent comprising desmocollin-1 cell adhesion recognition sequence
IYGYATTA

SEQ ID NO: 273 - protein, 9 aa, Artificial Sequence
  Modulating agent comprising desmocollin-1 cell adhesion recognition sequence
IYGYATTAD

SEQ ID NO: 274 - protein, 10 aa, Artificial Sequence
  Modulating agent comprising desmocollin-1 cell adhesion recognition sequence
IYGYATTADG

SEQ ID NO: 275 - protein, 6 aa, Artificial Sequence
  Modulating agent comprising desmocollin-1 cell adhesion recognition sequence
IYAYAT

SEQ ID NO: 276 - protein, 7 aa, Artificial Sequence
  Modulating agent comprising desmocollin-1 cell adhesion recognition sequence
IYAYATT

SEQ ID NO: 277 - protein, 8 aa, Artificial Sequence
  Modulating agent comprising desmocollin-1 cell adhesion recognition sequence
IYAYATTA

SEQ ID NO: 278 - protein, 9 aa, Artificial Sequence
  Modulating agent comprising desmocollin-1 cell adhesion recognition sequence
IYAYATTAD

SEQ ID NO: 279 - protein, 10 aa, Artificial Sequence
  Modulating agent comprising desmocollin-1 cell adhesion recognition sequence
IYAYATTADG

SEQ ID NO: 280 - protein, 10 aa, Artificial Sequence
  Modulating agent comprising desmocollin-1 cell adhesion recognition sequence
  ACETYLATION 1
  AMIDATION 10
LYGYATTADG

SEQ ID NO: 281 - protein, 10 aa, Artificial Sequence
  Modulating agent comprising desmocollin-1 cell adhesion recognition sequence
  ACETYLATION 1
  AMIDATION 10
LYAYATTADG

SEQ ID NO: 282 - protein, 10 aa, Artificial Sequence
  Modulating agent comprising desmocollin-1 cell adhesion recognition sequence
  ACETYLATION 1
  AMIDATION 10
VYGYATTADG

SEQ ID NO: 283 - protein, 10 aa, Artificial Sequence
  Modulating agent comprising desmocollin-1 cell adhesion recognition sequence
  ACETYLATION 1
  AMIDATION 10
VYAYATTADG

SEQ ID NO: 284 - protein, 10 aa, Artificial Sequence
  Modulating agent comprising desmocollin-1 cell adhesion recognition sequence
  ACETYLATION 1
  AMIDATION 10
IYGYATTADG

SEQ ID NO: 285 - protein, 10 aa, Artificial Sequence
  Modulating agent comprising desmocollin-1 cell adhesion recognition sequence
  ACETYLATION 1
  AMIDATION 10
IYAYATTADG

SEQ ID NO: 286 - protein, 4 aa, Artificial Sequence
  Modulating agent comprising desmocollin-2 cell adhesion recognition sequence
FATT

SEQ ID NO: 287 - protein, 5 aa, Artificial Sequence
  Modulating agent comprising desmocollin-2 cell adhesion recognition sequence
FATTP

SEQ ID NO: 288 - protein, 6 aa, Artificial Sequence
  Modulating agent comprising desmocollin-2 cell adhesion recognition sequence
FATTPD

SEQ ID NO: 289 - protein, 7 aa, Artificial Sequence
  Modulating agent comprising desmocollin-2 cell adhesion recognition sequence
FATTPDG

SEQ ID NO: 290 - protein, 4 aa, Artificial Sequence
  Modulating agent comprising desmocollin-2 cell adhesion recognition sequence
AFAT

SEQ ID NO: 291 - protein, 5 aa, Artificial Sequence
  Modulating agent comprising desmocollin-2 cell adhesion recognition sequence
AFATT

SEQ ID NO: 292 - protein, 6 aa, Artificial Sequence
  Modulating agent comprising desmocollin-2 cell adhesion recognition sequence
AFATTP

SEQ ID NO: 293 - protein, 7 aa, Artificial Sequence
  Modulating agent comprising desmocollin-2 cell adhesion recognition sequence
AFATTPD

SEQ ID NO: 294 - protein, 8 aa, Artificial Sequence
  Modulating agent comprising desmocollin-2 cell adhesion recognition sequence
AFATTPDG

SEQ ID NO: 295 - protein, 5 aa, Artificial Sequence
  Modulating agent comprising desmocollin-2 cell adhesion recognition sequence
IAFAT

SEQ ID NO: 296 - protein, 6 aa, Artificial Sequence
  Modulating agent comprising desmocollin-2 cell adhesion recognition sequence
IAFATT

SEQ ID NO: 297 - protein, 7 aa, Artificial Sequence
  Modulating agent comprising desmocollin-2 cell adhesion recognition sequence
IAFATTP

SEQ ID NO: 298 - protein, 8 aa, Artificial Sequence
  Modulating agent comprising desmocollin-2 cell adhesion recognition sequence
IAFATTPD

SEQ ID NO: 299 - protein, 9 aa, Artificial Sequence
  Modulating agent comprising desmocollin-2 cell adhesion recognition sequence
IAFATTPDG

SEQ ID NO: 300 - protein, 6 aa, Artificial Sequence
  Modulating agent comprising desmocollin-2 cell adhesion recognition sequence
IIAFAT

SEQ ID NO: 301 - protein, 7 aa, Artificial Sequence
  Modulating agent comprising desmocollin-2 cell adhesion recognition sequence
IIAFATT

SEQ ID NO: 302 - protein, 8 aa, Artificial Sequence
  Modulating agent comprising desmocollin-2 cell adhesion recognition sequence
IIAFATTP

SEQ ID NO: 303 - protein, 9 aa, Artificial Sequence
  Modulating agent comprising desmocollin-2 cell adhesion recognition sequence
IIAFATTPD

SEQ ID NO: 304 - protein, 10 aa, Artificial Sequence
  Modulating agent comprising desmocollin-2 cell adhesion recognition sequence
IIAFATTPDG

SEQ ID NO: 305 - protein, 6 aa, Artificial Sequence
  Modulating agent comprising desmocollin-2 cell adhesion recognition sequence
LIAFAT

SEQ ID NO: 306 - protein, 7 aa, Artificial Sequence
  Modulating agent comprising desmocollin-2 cell adhesion recognition sequence
LIAFATT

SEQ ID NO: 307 - protein, 8 aa, Artificial Sequence
  Modulating agent comprising desmocollin-2 cell adhesion recognition sequence
LIAFATTP

SEQ ID NO: 308 - protein, 9 aa, Artificial Sequence
  Modulating agent comprising desmocollin-2 cell adhesion recognition sequence
LIAFATTPD

SEQ ID NO: 309 - protein, 10 aa, Artificial Sequence
  Modulating agent comprising desmocollin-2 cell adhesion recognition sequence
LIAFATTPDG

SEQ ID NO: 310 - protein, 10 aa, Artificial Sequence
  Modulating agent comprising desmocollin-2 cell adhesion recognition sequence
  ACETYLATION 1
  AMIDATION 10
IIAFATTPDG

SEQ ID NO: 311 - protein, 10 aa, Artificial Sequence
  Modulating agent comprising desmocollin-2 cell adhesion recognition sequence
  ACETYLATION 1
  AMIDATION 10
LIAFATTPDG

SEQ ID NO: 312 - protein, 4 aa, Artificial Sequence
  Modulating agent comprising desmocollin-3 or desomcollin-4 cell adhesion recognition sequence
YAST

SEQ ID NO: 313 - protein, 5 aa, Artificial Sequence
  Modulating agent comprising desmocollin-3 or desomcollin-4 cell adhesion recognition sequence
YASTA

SEQ ID NO: 314 - protein, 6 aa, Artificial Sequence
  Modulating agent comprising desmocollin-3 or desomcollin-4 cell adhesion recognition sequence
YASTAD

SEQ ID NO: 315 - protein, 7 aa, Artificial Sequence
  Modulating agent comprising desmocollin-3 or desomcollin-4 cell adhesion recognition sequence
YASTADG

SEQ ID NO: 316 - protein, 4 aa, Artificial Sequence
  Modulating agent comprising desmocollin-3 or desomcollin-4 cell adhesion recognition sequence
AYAS

SEQ ID NO: 317 - protein, 5 aa, Artificial Sequence
  Modulating agent comprising desmocollin-3 or desomcollin-4 cell adhesion recognition sequence
AYAST

SEQ ID NO: 318 - protein, 6 aa, Artificial Sequence
  Modulating agent comprising desmocollin-3 or desomcollin-4 cell adhesion recognition sequence
AYASTA

SEQ ID NO: 319 - protein, 7 aa, Artificial Sequence
  Modulating agent comprising desmocollin-3 or desomcollin-4 cell adhesion recognition sequence
AYASTAD

SEQ ID NO: 320 - protein, 8 aa, Artificial Sequence
  Modulating agent comprising desmocollin-3 or desomcollin-4 cell adhesion recognition sequence
AYASTADG

SEQ ID NO: 321 - protein, 5 aa, Artificial Sequence
  Modulating agent comprising desmocollin-3 or desomcollin-4 cell adhesion recognition sequence
IAYAS

SEQ ID NO: 322 - protein, 6 aa, Artificial Sequence
  Modulating agent comprising desmocollin-3 or desomcollin-4 cell adhesion recognition sequence
IAYAST

SEQ ID NO: 323 - protein, 7 aa, Artificial Sequence
  Modulating agent comprising desmocollin-3 or desomcollin-4 cell adhesion recognition sequence
IAYASTA

SEQ ID NO: 324 - protein, 8 aa, Artificial Sequence
  Modulating agent comprising desmocollin-3 or desomcollin-4 cell adhesion recognition sequence
IAYASTAD

SEQ ID NO: 325 - protein, 9 aa, Artificial Sequence
  Modulating agent comprising desmocollin-3 or desomcollin-4 cell adhesion recognition sequence
IAYASTADG

SEQ ID NO: 326 - protein, 6 aa, Artificial Sequence
  Modulating agent comprising desmocollin-3 or desomcollin-4 cell adhesion recognition sequence
LIAYAS

SEQ ID NO: 327 - protein, 7 aa, Artificial Sequence
  Modulating agent comprising desmocollin-3 or desomcollin-4 cell adhesion recognition sequence
LIAYAST

SEQ ID NO: 328 - protein, 8 aa, Artificial Sequence
  Modulating agent comprising desmocollin-3 or desomcollin-4 cell adhesion recognition sequence
LIAYASTA

SEQ ID NO: 329 - protein, 9 aa, Artificial Sequence
  Modulating agent comprising desmocollin-3 or desomcollin-4 cell adhesion recognition sequence
LIAYASTAD

SEQ ID NO: 330 - protein, 10 aa, Artificial Sequence
  Modulating agent comprising desmocollin-3 or desomcollin-4 cell adhesion recognition sequence
LIAYASTADG

SEQ ID NO: 331 - protein, 10 aa, Artificial Sequence
  Modulating agent comprising desmocollin-3 or desomcollin-4 cell adhesion recognition sequence
  ACETYLATION 1
  AMIDATION 10
LIAYASTADG

SEQ ID NO: 332 - protein, 4 aa, Unknown
  Nonclassical cadherin calcium binding motif
  VARIANT 1,3: Xaa = any amino acid
XDXE

SEQ ID NO: 333 - protein, 5 aa, Unknown
  Nonclassical cadherin calcium binding motif
  VARIANT 2,3,5: Xaa = any amino acid
DXXDX

SEQ ID NO: 334 - protein, 4 aa, Unknown
  Nonclassical cadherin calcium binding motif
MDRE

SEQ ID NO: 335 - protein, 4 aa, Unknown
  Nonclassical cadherin calcium binding motif
LDFE

SEQ ID NO: 336 - protein, 4 aa, Unknown
  Nonclassical cadherin calcium binding motif
LDYE

SEQ ID NO: 337 - protein, 4 aa, Unknown
  Nonclassical cadherin calcium binding motif
IDRE

SEQ ID NO: 338 - protein, 4 aa, Unknown
  Nonclassical cadherin calcium binding motif
VDRE

SEQ ID NO: 339 - protein, 4 aa, Unknown
  Nonclassical cadherin calcium binding motif
IDFE

SEQ ID NO: 340 - protein, 11 aa, Unknown
  Nonclassical cadherin calcium binding motif
  VARIANT 1, 3: Xaa = Leucine, Isoleucine or Valine
  VARIANT 2, 4, 6, 10: Xaa = any amino acid
  VARIANT 9: Xaa = Asparagine or Histidine
XXXXDXNDXXP

SEQ ID NO: 341 - protein, 4 aa, Unknown
  Nonclassical cadherin calcium binding motif
DVNE

SEQ ID NO: 342 - protein, 5 aa, Unknown
  Nonclassical cadherin calcium binding motif
DINDN

SEQ ID NO: 343 - protein, 4 aa, Unknown
  Nonclassical cadherin calcium binding motif
VDFE

SEQ ID NO: 344 - protein, 4 aa, Unknown
  Nonclassical cadherin calcium binding motif
DADE

SEQ ID NO: 345 - protein, 5 aa, Unknown
  Nonclassical cadherin calcium binding motif
DVNDN

SEQ ID NO: 346 - protein, 5 aa, Unknown
  Nonclassical cadherin calcium binding motif
DINDN

SEQ ID NO: 347 - protein, 4 aa, Unknown
  Nonclassical cadherin calcium binding motif
DVDE

SEQ ID NO: 348 - protein, 5 aa, Unknown
  Nonclassical cadherin calcium binding motif
DENDN

SEQ ID NO: 349 - protein, 4 aa, Unknown
  Nonclassical cadherin calcium binding motif
LNYE

SEQ ID NO: 350 - protein, 5 aa, Unknown
  Nonclassical cadherin calcium binding motif
DQNDN

SEQ ID NO: 351 - protein, 4 aa, Unknown
  Nonclassical cadherin calcium binding motif
DTNE

SEQ ID NO: 352 - protein, 4 aa, Unknown
  Nonclassical cadherin calcium binding motif
EVND

SEQ ID NO: 353 - protein, 4 aa, Unknown
  Nonclassical cadherin calcium binding motif
DKND

SEQ ID NO: 354 - protein, 4 aa, Unknown
  Nonclassical cadherin calcium binding motif
DIND

SEQ ID NO: 355 - protein, 4 aa, Unknown
  Nonclassical cadherin calcium binding motif
LTRE

SEQ ID NO: 356 - protein, 5 aa, Unknown
  Nonclassical cadherin calcium binding motif
DINDQ

SEQ ID NO: 357 - protein, 5 aa, Unknown
  Nonclassical cadherin calcium binding motif
DANDN

SEQ ID NO: 358 - protein, 5 aa, Unknown
  Nonclassical cadherin calcium binding motif
DRNDN

SEQ ID NO: 359 - protein, 5 aa, Unknown
  Nonclassical cadherin calcium binding motif
DSNDN

SEQ ID NO: 360 - protein, 4 aa, Unknown
  Nonclassical cadherin calcium binding motif
FNFE

SEQ ID NO: 361 - protein, 4 aa, Unknown
  Nonclassical cadherin calcium binding motif
VDYE

SEQ ID NO: 362 - protein, 5 aa, Unknown
  Nonclassical cadherin calcium binding motif
DDNDN

SEQ ID NO: 363 - protein, 5 aa, Unknown
  Nonclassical cadherin calcium binding motif
DENDN

SEQ ID NO: 364 - protein, 5 aa, Unknown
  Nonclassical cadherin calcium binding motif
DYNDN

SEQ ID NO: 365 - protein, 4 aa, Unknown
  Nonclassical cadherin calcium binding motif
LDHE

SEQ ID NO: 366 - protein, 5 aa, Unknown
  Nonclassical cadherin calcium binding motif
DTNDN

SEQ ID NO: 367 - protein, 9 aa, Homo sapien
FFVIEEYTG

SEQ ID NO: 368 - protein, 9 aa, Homo sapien
IFVIDDKSG

SEQ ID NO: 369 - protein, 9 aa, Homo sapien
YFSVEAQTG

SEQ ID NO: 370 - protein, 9 aa, Homo sapien
VFRVDAETG

SEQ ID NO: 371 - protein, 9 aa, Homo sapien
FFLLEEYTG

SEQ ID NO: 372 - protein, 9 aa, Homo sapien
LFIINENTG

SEQ ID NO: 373 - protein, 9 aa, Homo sapien
YFSVESETG

SEQ ID NO: 374 - protein, 9 aa, Homo sapien
IFNIDSGNG

SEQ ID NO: 375 - protein, 9 aa, Gallus gallus
IFIIDENTG

SEQ ID NO: 376 - protein, 9 aa, Gallus gallus
YFSVEPKTG

SEQ ID NO: 377 - protein, 9 aa, Gallus gallus
YFNIDANSG

SEQ ID NO: 378 - protein, 9 aa, Homo sapiens
MFVLEEFSG

SEQ ID NO: 379 - protein, 9 aa, Homo sapiens
IFQINDVTG

SEQ ID NO: 380 - protein, 9 aa, Homo sapiens
VFTIDETTG

SEQ ID NO: 381 - protein, 9 aa, Homo sapiens
YFSIDPKTG

SEQ ID NO: 382 - protein, 9 aa, Homo sapiens
IFIIDDTTG

SEQ ID NO: 383 - protein, 9 aa, Homo sapiens
YFSVDPKTG

SEQ ID NO: 384 - protein, 9 aa, Homo sapiens
FFNIDANTG

SEQ ID NO: 385 - protein, 9 aa, Homo sapiens
VFSIDKFTG

SEQ ID NO: 386 - protein, 9 aa, Homo sapiens
LFSIDELTG

SEQ ID NO: 387 - protein, 9 aa, Homo sapiens
IFRINENTG

SEQ ID NO: 388 - protein, 9 aa, Rattus norvegicus
FFVVEEYTG

SEQ ID NO: 389 - protein, 9 aa, Rattus norvegicus
IFLIDELTG

SEQ ID NO: 390 - protein, 9 aa, Rattus norvegicus
HFTVDPKTG

SEQ ID NO: 391 - protein, 9 aa, Rattus norvegicus
IFDIDADTG

SEQ ID NO: 392 - protein, 9 aa, Homo sapiens
YFQINNKTG

SEQ ID NO: 393 - protein, 9 aa, Homo sapiens
LFALDLVTG

SEQ ID NO: 394 - protein, 9 aa, Homo sapiens
YFTINRDNG

SEQ ID NO: 395 - protein, 9 aa, Homo sapiens
LFSIDPKTG

SEQ ID NO: 396 - protein, 9 aa, Homo sapiens
LFEIDPSSG

SEQ ID NO: 397 - protein, 9 aa, Homo sapiens
IFVINQKTG

SEQ ID NO: 398 - protein, 9 aa, Homo sapiens
MFIINRNTG

SEQ ID NO: 399 - protein, 9 aa, Homo sapiens
VFYLNKDTG

SEQ ID NO: 400 - protein, 9 aa, Homo sapiens
LFYIEKDTG

SEQ ID NO: 401 - protein, 9 aa, Homo sapiens
LFYVERDTG

SEQ ID NO: 402 - protein, 9 aa, Homo sapiens
LFYIERDTG

SEQ ID NO: 403 - protein, 9 aa, Mus musculus
KFHIDPVSG

SEQ ID NO: 404 - protein, 9 aa, Mus musculus
QFSIDADTG

SEQ ID NO: 405 - protein, 9 aa, Mus musculus
TFHIDSVSG

SEQ ID NO: 406 - protein, 9 aa, Mus musculus
AFNIDSNSG

SEQ ID NO: 407 - protein, 9 aa, Mus musculus
KFTIDSSSG

SEQ ID NO: 408 - protein, 9 aa, Mus musculus
LFTLDEKNG

SEQ ID NO: 409 - protein, 9 aa, Mus musculus
KFLINEKTG

SEQ ID NO: 410 - protein, 5 aa, Artificial Sequence
  Cyclicized modulating agent comprising desomglein cell adhesion recognition sequence
CNQKC

SEQ ID NO: 411 - protein, 6 aa, Artificial Sequence
  Cyclicized modulating agent comprising desomglein cell adhesion recognition sequence
CNQKTC

SEQ ID NO: 412 - protein, 7 aa, Artificial Sequence
  Cyclicized modulating agent comprising desomglein cell adhesion recognition sequence
CNQKTGC

SEQ ID NO: 413 - protein, 6 aa, Artificial Sequence
  Cyclicized modulating agent comprising desomglein cell adhesion recognition sequence
CINQKC

SEQ ID NO: 414 - protein, 7 aa, Artificial Sequence
  Cyclicized modulating agent comprising desomglein cell adhesion recognition sequence
CINQKTC

SEQ ID NO: 415 - protein, 8 aa, Artificial Sequence
  Cyclicized modulating agent comprising desomglein cell adhesion recognition sequence
CINQKTGC

SEQ ID NO: 416 - protein, 7 aa, Artificial Sequence
  Cyclicized modulating agent comprising desomglein cell adhesion recognition sequence
CVINQKC

SEQ ID NO: 417 - protein, 8 aa, Artificial Sequence
  Cyclicized modulating agent comprising desomglein cell adhesion recognition sequence
CVINQKTC

SEQ ID NO: 418 - protein, 9 aa, Artificial Sequence
  Cyclicized modulating agent comprising desomglein cell adhesion recognition sequence
CVINQKTGC

SEQ ID NO: 419 - protein, 8 aa, Artificial Sequence
  Cyclicized modulating agent comprising desomglein cell adhesion recognition sequence
CFVINQKC

SEQ ID NO: 420 - protein, 9 aa, Artificial Sequence
  Cyclicized modulating agent comprising desomglein cell adhesion recognition sequence
CFVINQKTC

SEQ ID NO: 421 - protein, 10 aa, Artificial Sequence
  Cyclicized modulating agent comprising desomglein cell adhesion recognition sequence
CFVINQKTGC

SEQ ID NO: 422 - protein, 9 aa, Artificial Sequence
  Cyclicized modulating agent comprising desomglein cell adhesion recognition sequence
CIFVINQKC

SEQ ID NO: 423 - protein, 10 aa, Artificial Sequence
  Cyclicized modulating agent comprising desomglein cell adhesion recognition sequence
CIFVINQKTC

SEQ ID NO: 424 - protein, 11 aa, Artificial Sequence
  Cyclicized modulating agent comprising desomglein cell adhesion recognition sequence
CIFVINQKTGC

SEQ ID NO: 425 - protein, 5 aa, Artificial Sequence
  Cyclicized modulating agent comprising desomglein cell adhesion recognition sequence
CNRNC

SEQ ID NO: 426 - protein, 6 aa, Artificial Sequence
  Cyclicized modulating agent comprising desomglein cell adhesion recognition sequence
CNRNTC

SEQ ID NO: 427 - protein, 7 aa, Artificial Sequence
  Cyclicized modulating agent comprising desomglein cell adhesion recognition sequence
CNRNTGC

SEQ ID NO: 428 - protein, 6 aa, Artificial Sequence
  Cyclicized modulating agent comprising desomglein cell adhesion recognition sequence
CINRNC

SEQ ID NO: 429 - protein, 7 aa, Artificial Sequence
  Cyclicized modulating agent comprising desomglein cell adhesion recognition sequence
CINRNTC

SEQ ID NO: 430 - protein, 8 aa, Artificial Sequence
  Cyclicized modulating agent comprising desomglein cell adhesion recognition sequence
CINRNTGC

SEQ ID NO: 431 - protein, 7 aa, Artificial Sequence
  Cyclicized modulating agent comprising desomglein cell adhesion recognition sequence
CIINRNC

SEQ ID NO: 432 - protein, 8 aa, Artificial Sequence
  Cyclicized modulating agent comprising desomglein cell adhesion recognition sequence
CIINRNTC

SEQ ID NO: 433 - protein, 9 aa, Artificial Sequence
  Cyclicized modulating agent comprising desomglein cell adhesion recognition sequence
CIINRNTGC

SEQ ID NO: 434 - protein, 8 aa, Artificial Sequence
  Cyclicized modulating agent comprising desomglein cell adhesion recognition sequence
CFIINRNC

SEQ ID NO: 435 - protein, 9 aa, Artificial Sequence
  Cyclicized modulating agent comprising desomglein cell adhesion recognition sequence
CFIINRNTC

SEQ ID NO: 436 - protein, 10 aa, Artificial Sequence
  Cyclicized modulating agent comprising desomglein cell adhesion recognition sequence
CFIINRNTGC

SEQ ID NO: 437 - protein, 9 aa, Artificial Sequence
  Cyclicized modulating agent comprising desomglein cell adhesion recognition sequence
CMFIINRNC

SEQ ID NO: 438 - protein, 10 aa, Artificial Sequence
  Cyclicized modulating agent comprising desomglein cell adhesion recognition sequence
CMFIINRNTC

SEQ ID NO: 439 - protein, 11 aa, Artificial Sequence
  Cyclicized modulating agent comprising desomglein cell adhesion recognition sequence
CMFIINRNTGC

SEQ ID NO: 440 - protein, 5 aa, Artificial Sequence
  Cyclicized modulating agent comprising desomglein cell adhesion recognition sequence
CNKDC

SEQ ID NO: 441 - protein, 6 aa, Artificial Sequence
  Cyclicized modulating agent comprising desomglein cell adhesion recognition sequence
CNKDTC

SEQ ID NO: 442 - protein, 7 aa, Artificial Sequence
  Cyclicized modulating agent comprising desomglein cell adhesion recognition sequence
CNKDTGC

SEQ ID NO: 443 - protein, 6 aa, Artificial Sequence
  Cyclicized modulating agent comprising desomglein cell adhesion recognition sequence
CLNKDC

SEQ ID NO: 444 - protein, 7 aa, Artificial Sequence
  Cyclicized modulating agent comprising desomglein cell adhesion recognition sequence
CLNKDTC

SEQ ID NO: 445 - protein, 8 aa, Artificial Sequence
  Cyclicized modulating agent comprising desomglein cell adhesion recognition sequence
CLNKDTGC

SEQ ID NO: 446 - protein, 7 aa, Artificial Sequence
  Cyclicized modulating agent comprising desomglein cell adhesion recognition sequence
CYLNKDC

SEQ ID NO: 447 - protein, 8 aa, Artificial Sequence
  Cyclicized modulating agent comprising desomglein cell adhesion recognition sequence
CYLNKDTC

SEQ ID NO: 448 - protein, 9 aa, Artificial Sequence
  Cyclicized modulating agent comprising desomglein cell adhesion recognition sequence
CYLNKDTGC

SEQ ID NO: 449 - protein, 8 aa, Artificial Sequence
  Cyclicized modulating agent comprising desomglein cell adhesion recognition sequence
CFYLNKDC

SEQ ID NO: 450 - protein, 9 aa, Artificial Sequence
  Cyclicized modulating agent comprising desomglein cell adhesion recognition sequence
CFYLNKDTC

SEQ ID NO: 451 - protein, 10 aa, Artificial Sequence
  Cyclicized modulating agent comprising desomglein cell adhesion recognition sequence
CFYLNKDTGC

SEQ ID NO: 452 - protein, 9 aa, Artificial Sequence
  Cyclicized modulating agent comprising desomglein cell adhesion recognition sequence
CVFYLNKDC

SEQ ID NO: 453 - protein, 10 aa, Artificial Sequence
  Cyclicized modulating agent comprising desomglein cell adhesion recognition sequence
CVFYLNKDTC

SEQ ID NO: 454 - protein, 11 aa, Artificial Sequence
  Cyclicized modulating agent comprising desomglein cell adhesion recognition sequence
CVFYLNKDTGC

SEQ ID NO: 455 - protein, 5 aa, Artificial Sequence
  Cyclicized modulating agent comprising desomglein cell adhesion recognition sequence
ENQKK

SEQ ID NO: 456 - protein, 6 aa, Artificial Sequence
  Cyclicized modulating agent comprising desomglein cell adhesion recognition sequence
ENQKTK

SEQ ID NO: 457 - protein, 7 aa, Artificial Sequence
  Cyclicized modulating agent comprising desomglein cell adhesion recognition sequence
ENQKTGK

SEQ ID NO: 458 - protein, 6 aa, Artificial Sequence
  Cyclicized modulating agent comprising desomglein cell adhesion recognition sequence
EINQKK

SEQ ID NO: 459 - protein, 7 aa, Artificial Sequence
  Cyclicized modulating agent comprising desomglein cell adhesion recognition sequence
EINQKTK

SEQ ID NO: 460 - protein, 8 aa, Artificial Sequence
  Cyclicized modulating agent comprising desomglein cell adhesion recognition sequence
EINQKTGK

SEQ ID NO: 461 - protein, 7 aa, Artificial Sequence
  Cyclicized modulating agent comprising desomglein cell adhesion recognition sequence
EVINQKK

SEQ ID NO: 462 - protein, 8 aa, Artificial Sequence
  Cyclicized modulating agent comprising desomglein cell adhesion recognition sequence
EVINQKTK

SEQ ID NO: 463 - protein, 9 aa, Artificial Sequence
  Cyclicized modulating agent comprising desomglein cell adhesion recognition sequence
EVINQKTGK

SEQ ID NO: 464 - protein, 8 aa, Artificial Sequence
  Cyclicized modulating agent comprising desomglein cell adhesion recognition sequence
EFVINQKK

SEQ ID NO: 465 - protein, 9 aa, Artificial Sequence
  Cyclicized modulating agent comprising desomglein cell adhesion recognition sequence
EFVINQKTK

SEQ ID NO: 466 - protein, 10 aa, Artificial Sequence
  Cyclicized modulating agent comprising desomglein cell adhesion recognition sequence
EFVINQKTGK

SEQ ID NO: 467 - protein, 9 aa, Artificial Sequence
  Cyclicized modulating agent comprising desomglein cell adhesion recognition sequence
EIFVINQKK

SEQ ID NO: 468 - protein, 10 aa, Artificial Sequence
  Cyclicized modulating agent comprising desomglein cell adhesion recognition sequence
EIFVINQKTK

SEQ ID NO: 469 - protein, 11 aa, Artificial Sequence
  Cyclicized modulating agent comprising desomglein cell adhesion recognition sequence
EIFVINQKTGK

SEQ ID NO: 470 - protein, 5 aa, Artificial Sequence
  Cyclicized modulating agent comprising desomglein cell adhesion recognition sequence
ENRNK

SEQ ID NO: 471 - protein, 6 aa, Artificial Sequence
  Cyclicized modulating agent comprising desomglein cell adhesion recognition sequence
ENRNTK

SEQ ID NO: 472 - protein, 7 aa, Artificial Sequence
  Cyclicized modulating agent comprising desomglein cell adhesion recognition sequence
ENRNTGK

SEQ ID NO: 473 - protein, 6 aa, Artificial Sequence
  Cyclicized modulating agent comprising desomglein cell adhesion recognition sequence
EINRNK

SEQ ID NO: 474 - protein, 7 aa, Artificial Sequence
  Cyclicized modulating agent comprising desomglein cell adhesion recognition sequence
EINRNTK

SEQ ID NO: 475 - protein, 8 aa, Artificial Sequence
  Cyclicized modulating agent comprising desomglein cell adhesion recognition sequence
EINRNTGK

SEQ ID NO: 476 - protein, 7 aa, Artificial Sequence
  Cyclicized modulating agent comprising desomglein cell adhesion recognition sequence
EIINRNK

SEQ ID NO: 477 - protein, 8 aa, Artificial Sequence
  Cyclicized modulating agent comprising desomglein cell adhesion recognition sequence
EIINRNTK

SEQ ID NO: 478 - protein, 9 aa, Artificial Sequence
  Cyclicized modulating agent comprising desomglein cell adhesion recognition sequence
EIINRNTGK

SEQ ID NO: 479 - protein, 8 aa, Artificial Sequence
  Cyclicized modulating agent comprising desomglein cell adhesion recognition sequence
EFIINRNK

SEQ ID NO: 480 - protein, 9 aa, Artificial Sequence
  Cyclicized modulating agent comprising desomglein cell adhesion recognition sequence
EFIINRNTK

SEQ ID NO: 481 - protein, 10 aa, Artificial Sequence
  Cyclicized modulating agent comprising desomglein cell adhesion recognition sequence
EFIINRNTGK

SEQ ID NO: 482 - protein, 9 aa, Artificial Sequence
  Cyclicized modulating agent comprising desomglein cell adhesion recognition sequence
EMFIINRNK

SEQ ID NO: 483 - protein, 10 aa, Artificial Sequence
  Cyclicized modulating agent comprising desomglein cell adhesion recognition sequence
EMFIINRNTK

SEQ ID NO: 484 - protein, 11 aa, Artificial Sequence
  Cyclicized modulating agent comprising desomglein cell adhesion recognition sequence
EMFIINRNTGK

SEQ ID NO: 485 - protein, 5 aa, Artificial Sequence
  Cyclicized modulating agent comprising desomglein cell adhesion recognition sequence
ENKDK

SEQ ID NO: 486 - protein, 6 aa, Artificial Sequence
  Cyclicized modulating agent comprising desomglein cell adhesion recognition sequence
ENKDTK

SEQ ID NO: 487 - protein, 7 aa, Artificial Sequence
  Cyclicized modulating agent comprising desomglein cell adhesion recognition sequence
ENKDTGK

SEQ ID NO: 488 - protein, 6 aa, Artificial Sequence
  Cyclicized modulating agent comprising desomglein cell adhesion recognition sequence
ELNKDK

SEQ ID NO: 489 - protein, 7 aa, Artificial Sequence
  Cyclicized modulating agent comprising desomglein cell adhesion recognition sequence
ELNKDTK

SEQ ID NO: 490 - protein, 8 aa, Artificial Sequence
  Cyclicized modulating agent comprising desomglein cell adhesion recognition sequence
ELNKDTGK

SEQ ID NO: 491 - protein, 7 aa, Artificial Sequence
  Cyclicized modulating agent comprising desomglein cell adhesion recognition sequence
EYLNKDK

SEQ ID NO: 492 - protein, 8 aa, Artificial Sequence
  Cyclicized modulating agent comprising desomglein cell adhesion recognition sequence
EYLNKDTK

SEQ ID NO: 493 - protein, 9 aa, Artificial Sequence
  Cyclicized modulating agent comprising desomglein cell adhesion recognition sequence
EYLNKDTGK

SEQ ID NO: 494 - protein, 8 aa, Artificial Sequence
  Cyclicized modulating agent comprising desomglein cell adhesion recognition sequence
EFYLNKDK

SEQ ID NO: 495 - protein, 9 aa, Artificial Sequence
  Cyclicized modulating agent comprising desomglein cell adhesion recognition sequence
EFYLNKDTK

SEQ ID NO: 496 - protein, 10 aa, Artificial Sequence
  Cyclicized modulating agent comprising desomglein cell adhesion recognition sequence
EFYLNKDTGK

SEQ ID NO: 497 - protein, 9 aa, Artificial Sequence
  Cyclicized modulating agent comprising desomglein cell adhesion recognition sequence
EVFYLNKDK

SEQ ID NO: 498 - protein, 10 aa, Artificial Sequence
  Cyclicized modulating agent comprising desomglein cell adhesion recognition sequence
EVFYLNKDTK

SEQ ID NO: 499 - protein, 11 aa, Artificial Sequence
  Cyclicized modulating agent comprising desomglein cell adhesion recognition sequence
EVFYLNKDTGK

SEQ ID NO: 500 - protein, 5 aa, Artificial Sequence
  Cyclicized modulating agent comprising desomglein cell adhesion recognition sequence
KNQKD

SEQ ID NO: 501 - protein, 6 aa, Artificial Sequence
  Cyclicized modulating agent comprising desomglein cell adhesion recognition sequence
KNQKTD

SEQ ID NO: 502 - protein, 7 aa, Artificial Sequence
  Cyclicized modulating agent comprising desomglein cell adhesion recognition sequence
KNQKTGD

SEQ ID NO: 503 - protein, 6 aa, Artificial Sequence
  Cyclicized modulating agent comprising desomglein cell adhesion recognition sequence
KINQKD

SEQ ID NO: 504 - protein, 7 aa, Artificial Sequence
  Cyclicized modulating agent comprising desomglein cell adhesion recognition sequence
KINQKTD

SEQ ID NO: 505 - protein, 8 aa, Artificial Sequence
  Cyclicized modulating agent comprising desomglein cell adhesion recognition sequence
KINQKTGD

SEQ ID NO: 506 - protein, 7 aa, Artificial Sequence
  Cyclicized modulating agent comprising desomglein cell adhesion recognition sequence
KVINQKD

SEQ ID NO: 507 - protein, 8 aa, Artificial Sequence
  Cyclicized modulating agent comprising desomglein cell adhesion recognition sequence
KVINQKTD

SEQ ID NO: 508 - protein, 9 aa, Artificial Sequence
  Cyclicized modulating agent comprising desomglein cell adhesion recognition sequence
KVINQKTGD

SEQ ID NO: 509 - protein, 8 aa, Artificial Sequence
  Cyclicized modulating agent comprising desomglein cell adhesion recognition sequence
KFVINQKD

SEQ ID NO: 510 - protein, 9 aa, Artificial Sequence
  Cyclicized modulating agent comprising desomglein cell adhesion recognition sequence
KFVINQKTD

SEQ ID NO: 511 - protein, 10 aa, Artificial Sequence
  Cyclicized modulating agent comprising desomglein cell adhesion recognition sequence
KFVINQKTGD

SEQ ID NO: 512 - protein, 9 aa, Artificial Sequence
  Cyclicized modulating agent comprising desomglein cell adhesion recognition sequence
KIFVINQKD

SEQ ID NO: 513 - protein, 10 aa, Artificial Sequence
  Cyclicized modulating agent comprising desomglein cell adhesion recognition sequence
KIFVINQKTD

SEQ ID NO: 514 - protein, 11 aa, Artificial Sequence
  Cyclicized modulating agent comprising desomglein cell adhesion recognition sequence
KIFVINQKTGD

SEQ ID NO: 515 - protein, 5 aa, Artificial Sequence
  Cyclicized modulating agent comprising desomglein cell adhesion recognition sequence
KNRND

SEQ ID NO: 516 - protein, 6 aa, Artificial Sequence
  Cyclicized modulating agent comprising desomglein cell adhesion recognition sequence
KNRNTD

SEQ ID NO: 517 - protein, 7 aa, Artificial Sequence
  Cyclicized modulating agent comprising desomglein cell adhesion recognition sequence
KNRNTGD

SEQ ID NO: 518 - protein, 6 aa, Artificial Sequence
  Cyclicized modulating agent comprising desomglein cell adhesion recognition sequence
KINRND

SEQ ID NO: 519 - protein, 7 aa, Artificial Sequence
  Cyclicized modulating agent comprising desomglein cell adhesion recognition sequence
KINRNTD

SEQ ID NO: 520 - protein, 8 aa, Artificial Sequence
  Cyclicized modulating agent comprising desomglein cell adhesion recognition sequence
KINRNTGD

SEQ ID NO: 521 - protein, 7 aa, Artificial Sequence
  Cyclicized modulating agent comprising desomglein cell adhesion recognition sequence
KIINRND

SEQ ID NO: 522 - protein, 8 aa, Artificial Sequence
  Cyclicized modulating agent comprising desomglein cell adhesion recognition sequence
KIINRNTD

SEQ ID NO: 523 - protein, 9 aa, Artificial Sequence
  Cyclicized modulating agent comprising desomglein cell adhesion recognition sequence
KIINRNTGD

SEQ ID NO: 524 - protein, 8 aa, Artificial Sequence
  Cyclicized modulating agent comprising desomglein cell adhesion recognition sequence
KFIINRND

SEQ ID NO: 525 - protein, 9 aa, Artificial Sequence
  Cyclicized modulating agent comprising desomglein cell adhesion recognition sequence
KFIINRNTD

SEQ ID NO: 526 - protein, 10 aa, Artificial Sequence
  Cyclicized modulating agent comprising desomglein cell adhesion recognition sequence
KFIINRNTGD

SEQ ID NO: 527 - protein, 9 aa, Artificial Sequence
  Cyclicized modulating agent comprising desomglein cell adhesion recognition sequence
KMFIINRND

SEQ ID NO: 528 - protein, 10 aa, Artificial Sequence
  Cyclicized modulating agent comprising desomglein cell adhesion recognition sequence
KMFIINRNTD

SEQ ID NO: 529 - protein, 11 aa, Artificial Sequence
  Cyclicized modulating agent comprising desomglein cell adhesion recognition sequence
KMFIINRNTGD

SEQ ID NO: 530 - protein, 5 aa, Artificial Sequence
  Cyclicized modulating agent comprising desomglein cell adhesion recognition sequence
KNKDD

SEQ ID NO: 531 - protein, 6 aa, Artificial Sequence
  Cyclicized modulating agent comprising desomglein cell adhesion recognition sequence
KNKDTD

SEQ ID NO: 532 - protein, 7 aa, Artificial Sequence
  Cyclicized modulating agent comprising desomglein cell adhesion recognition sequence
KNKDTGD

SEQ ID NO: 533 - protein, 6 aa, Artificial Sequence
  Cyclicized modulating agent comprising desomglein cell adhesion recognition sequence
KLNKDD

SEQ ID NO: 534 - protein, 7 aa, Artificial Sequence
  Cyclicized modulating agent comprising desomglein cell adhesion recognition sequence
KLNKDTD

SEQ ID NO: 535 - protein, 8 aa, Artificial Sequence
  Cyclicized modulating agent comprising desomglein cell adhesion recognition sequence
KLNKDTGD

SEQ ID NO: 536 - protein, 7 aa, Artificial Sequence
  Cyclicized modulating agent comprising desomglein cell adhesion recognition sequence
KYLNKDD

SEQ ID NO: 537 - protein, 8 aa, Artificial Sequence
  Cyclicized modulating agent comprising desomglein cell adhesion recognition sequence
KYLNKDTD

SEQ ID NO: 538 - protein, 9 aa, Artificial Sequence
  Cyclicized modulating agent comprising desomglein cell adhesion recognition sequence
KYLNKDTGD

SEQ ID NO: 539 - protein, 8 aa, Artificial Sequence
  Cyclicized modulating agent comprising desomglein cell adhesion recognition sequence
KFYLNKDD

SEQ ID NO: 540 - protein, 9 aa, Artificial Sequence
  Cyclicized modulating agent comprising desomglein cell adhesion recognition sequence
KFYLNKDTD

SEQ ID NO: 541 - protein, 10 aa, Artificial Sequence
  Cyclicized modulating agent comprising desomglein cell adhesion recognition sequence
KFYLNKDTGD

SEQ ID NO: 542 - protein, 9 aa, Artificial Sequence
  Cyclicized modulating agent comprising desomglein cell adhesion recognition sequence
KVFYLNKDD

SEQ ID NO: 543 - protein, 10 aa, Artificial Sequence
  Cyclicized modulating agent comprising desomglein cell adhesion recognition sequence
KVFYLNKDTD

SEQ ID NO: 544 - protein, 11 aa, Artificial Sequence
  Cyclicized modulating agent comprising desomglein cell adhesion recognition sequence
KVFYLNKDTGD

SEQ ID NO: 545 - protein, 5 aa, Artificial Sequence
  Cyclicized modulating agent comprising desomglein cell adhesion recognition sequence
DNQKK

SEQ ID NO: 546 - protein, 6 aa, Artificial Sequence
  Cyclicized modulating agent comprising desomglein cell adhesion recognition sequence
DNQKTK

SEQ ID NO: 547 - protein, 7 aa, Artificial Sequence
  Cyclicized modulating agent comprising desomglein cell adhesion recognition sequence
DNQKTGK

SEQ ID NO: 548 - protein, 6 aa, Artificial Sequence
  Cyclicized modulating agent comprising desomglein cell adhesion recognition sequence
DINQKK

SEQ ID NO: 549 - protein, 7 aa, Artificial Sequence
  Cyclicized modulating agent comprising desomglein cell adhesion recognition sequence
DINQKTK

SEQ ID NO: 550 - protein, 8 aa, Artificial Sequence
  Cyclicized modulating agent comprising desomglein cell adhesion recognition sequence
DINQKTGK

SEQ ID NO: 551 - protein, 7 aa, Artificial Sequence
  Cyclicized modulating agent comprising desomglein cell adhesion recognition sequence
DVINQKK

SEQ ID NO: 552 - protein, 8 aa, Artificial Sequence
  Cyclicized modulating agent comprising desomglein cell adhesion recognition sequence
DVINQKTK

SEQ ID NO: 553 - protein, 9 aa, Artificial Sequence
  Cyclicized modulating agent comprising desomglein cell adhesion recognition sequence
DVINQKTGK

SEQ ID NO: 554 - protein, 8 aa, Artificial Sequence
  Cyclicized modulating agent comprising desomglein cell adhesion recognition sequence
DFVINQKK

SEQ ID NO: 555 - protein, 9 aa, Artificial Sequence
  Cyclicized modulating agent comprising desomglein cell adhesion recognition sequence
DFVINQKTK

SEQ ID NO: 556 - protein, 10 aa, Artificial Sequence
  Cyclicized modulating agent comprising desomglein cell adhesion recognition sequence
DFVINQKTGK

SEQ ID NO: 557 - protein, 9 aa, Artificial Sequence
  Cyclicized modulating agent comprising desomglein cell adhesion recognition sequence
DIFVINQKK

SEQ ID NO: 558 - protein, 10 aa, Artificial Sequence
  Cyclicized modulating agent comprising desomglein cell adhesion recognition sequence
DIFVINQKTK

SEQ ID NO: 559 - protein, 11 aa, Artificial Sequence
  Cyclicized modulating agent comprising desomglein cell adhesion recognition sequence
DIFVINQKTGK

SEQ ID NO: 560 - protein, 5 aa, Artificial Sequence
  Cyclicized modulating agent comprising desomglein cell adhesion recognition sequence
DNRNK

SEQ ID NO: 561 - protein, 6 aa, Artificial Sequence
  Cyclicized modulating agent comprising desomglein cell adhesion recognition sequence
DNRNTK

SEQ ID NO: 562 - protein, 7 aa, Artificial Sequence
  Cyclicized modulating agent comprising desomglein cell adhesion recognition sequence
DNRNTGK

SEQ ID NO: 563 - protein, 6 aa, Artificial Sequence
  Cyclicized modulating agent comprising desomglein cell adhesion recognition sequence
DINRNK

SEQ ID NO: 564 - protein, 7 aa, Artificial Sequence
  Cyclicized modulating agent comprising desomglein cell adhesion recognition sequence
DINRNTK

SEQ ID NO: 565 - protein, 8 aa, Artificial Sequence
  Cyclicized modulating agent comprising desomglein cell adhesion recognition sequence
DINRNTGK

SEQ ID NO: 566 - protein, 7 aa, Artificial Sequence
  Cyclicized modulating agent comprising desomglein cell adhesion recognition sequence
DIINRNK

SEQ ID NO: 567 - protein, 8 aa, Artificial Sequence
  Cyclicized modulating agent comprising desomglein cell adhesion recognition sequence
DIINRNTK

SEQ ID NO: 568 - protein, 9 aa, Artificial Sequence
  Cyclicized modulating agent comprising desomglein cell adhesion recognition sequence
DIINRNTGK

SEQ ID NO: 569 - protein, 8 aa, Artificial Sequence
  Cyclicized modulating agent comprising desomglein cell adhesion recognition sequence
DFIINRNK

SEQ ID NO: 570 - protein, 9 aa, Artificial Sequence
  Cyclicized modulating agent comprising desomglein cell adhesion recognition sequence
DFIINRNTK

SEQ ID NO: 571 - protein, 10 aa, Artificial Sequence
  Cyclicized modulating agent comprising desomglein cell adhesion recognition sequence
DFIINRNTGK

SEQ ID NO: 572 - protein, 9 aa, Artificial Sequence
  Cyclicized modulating agent comprising desomglein cell adhesion recognition sequence
DMFIINRNK

SEQ ID NO: 573 - protein, 10 aa, Artificial Sequence
  Cyclicized modulating agent comprising desomglein cell adhesion recognition sequence
DMFIINRNTK

SEQ ID NO: 574 - protein, 11 aa, Artificial Sequence
  Cyclicized modulating agent comprising desomglein cell adhesion recognition sequence
DMFIINRNTGK

SEQ ID NO: 575 - protein, 5 aa, Artificial Sequence
  Cyclicized modulating agent comprising desomglein cell adhesion recognition sequence
DNKDK

SEQ ID NO: 576 - protein, 6 aa, Artificial Sequence
  Cyclicized modulating agent comprising desomglein cell adhesion recognition sequence
DNKDTK

SEQ ID NO: 577 - protein, 7 aa, Artificial Sequence
  Cyclicized modulating agent comprising desomglein cell adhesion recognition sequence
DNKDTGK

SEQ ID NO: 578 - protein, 6 aa, Artificial Sequence
  Cyclicized modulating agent comprising desomglein cell adhesion recognition sequence
DLNKDK

SEQ ID NO: 579 - protein, 7 aa, Artificial Sequence
  Cyclicized modulating agent comprising desomglein cell adhesion recognition sequence
DLNKDTK

SEQ ID NO: 580 - protein, 8 aa, Artificial Sequence
  Cyclicized modulating agent comprising desomglein cell adhesion recognition sequence
DLNKDTGK

SEQ ID NO: 581 - protein, 7 aa, Artificial Sequence
  Cyclicized modulating agent comprising desomglein cell adhesion recognition sequence
DYLNKDK

SEQ ID NO: 582 - protein, 8 aa, Artificial Sequence
  Cyclicized modulating agent comprising desomglein cell adhesion recognition sequence
DYLNKDTK

SEQ ID NO: 583 - protein, 9 aa, Artificial Sequence
  Cyclicized modulating agent comprising desomglein cell adhesion recognition sequence
DYLNKDTGK

SEQ ID NO: 584 - protein, 8 aa, Artificial Sequence
  Cyclicized modulating agent comprising desomglein cell adhesion recognition sequence
DFYLNKDK

SEQ ID NO: 585 - protein, 9 aa, Artificial Sequence
  Cyclicized modulating agent comprising desomglein cell adhesion recognition sequence
DFYLNKDTK

SEQ ID NO: 586 - protein, 10 aa, Artificial Sequence
  Cyclicized modulating agent comprising desomglein cell adhesion recognition sequence
DFYLNKDTGK

SEQ ID NO: 587 - protein, 9 aa, Artificial Sequence
  Cyclicized modulating agent comprising desomglein cell adhesion recognition sequence
DVFYLNKDK

SEQ ID NO: 588 - protein, 10 aa, Artificial Sequence
  Cyclicized modulating agent comprising desomglein cell adhesion recognition sequence
DVFYLNKDTK

SEQ ID NO: 589 - protein, 11 aa, Artificial Sequence
  Cyclicized modulating agent comprising desomglein cell adhesion recognition sequence
DVFYLNKDTGK

SEQ ID NO: 590 - protein, 6 aa, Artificial Sequence
  Cyclicized modulating agent comprising desomglein cell adhesion recognition sequence
KKNQKE

SEQ ID NO: 591 - protein, 6 aa, Artificial Sequence
  Cyclicized modulating agent comprising desomglein cell adhesion recognition sequence
KNQKTE

SEQ ID NO: 592 - protein, 7 aa, Artificial Sequence
  Cyclicized modulating agent comprising desomglein cell adhesion recognition sequence
KNQKTGE

SEQ ID NO: 593 - protein, 6 aa, Artificial Sequence
  Cyclicized modulating agent comprising desomglein cell adhesion recognition sequence
KINQKE

SEQ ID NO: 594 - protein, 7 aa, Artificial Sequence
  Cyclicized modulating agent comprising desomglein cell adhesion recognition sequence
KINQKTE

SEQ ID NO: 595 - protein, 8 aa, Artificial Sequence
  Cyclicized modulating agent comprising desomglein cell adhesion recognition sequence
KINQKTGE

SEQ ID NO: 596 - protein, 7 aa, Artificial Sequence
  Cyclicized modulating agent comprising desomglein cell adhesion recognition sequence
KVINQKE

SEQ ID NO: 597 - protein, 8 aa, Artificial Sequence
  Cyclicized modulating agent comprising desomglein cell adhesion recognition sequence
KVINQKTE

SEQ ID NO: 598 - protein, 9 aa, Artificial Sequence
  Cyclicized modulating agent comprising desomglein cell adhesion recognition sequence
KVINQKTGE

SEQ ID NO: 599 - protein, 8 aa, Artificial Sequence
  Cyclicized modulating agent comprising desomglein cell adhesion recognition sequence
KFVINQKE

SEQ ID NO: 600 - protein, 9 aa, Artificial Sequence
  Cyclicized modulating agent comprising desomglein cell adhesion recognition sequence
KFVINQKTE

SEQ ID NO: 601 - protein, 10 aa, Artificial Sequence
  Cyclicized modulating agent comprising desomglein cell adhesion recognition sequence
KFVINQKTGE

SEQ ID NO: 602 - protein, 9 aa, Artificial Sequence
  Cyclicized modulating agent comprising desomglein cell adhesion recognition sequence
KIFVINQKE

SEQ ID NO: 603 - protein, 10 aa, Artificial Sequence
  Cyclicized modulating agent comprising desomglein cell adhesion recognition sequence
KIFVINQKTE

SEQ ID NO: 604 - protein, 11 aa, Artificial Sequence
  Cyclicized modulating agent comprising desomglein cell adhesion recognition sequence
KIFVINQKTGE

SEQ ID NO: 605 - protein, 5 aa, Artificial Sequence
  Cyclicized modulating agent comprising desomglein cell adhesion recognition sequence
KNRNE

SEQ ID NO: 606 - protein, 6 aa, Artificial Sequence
  Cyclicized modulating agent comprising desomglein cell adhesion recognition sequence
KNRNTE

SEQ ID NO: 607 - protein, 7 aa, Artificial Sequence
  Cyclicized modulating agent comprising desomglein cell adhesion recognition sequence
KNRNTGE

SEQ ID NO: 608 - protein, 6 aa, Artificial Sequence
  Cyclicized modulating agent comprising desomglein cell adhesion recognition sequence
KINRNE

SEQ ID NO: 609 - protein, 7 aa, Artificial Sequence
  Cyclicized modulating agent comprising desomglein cell adhesion recognition sequence
KINRNTE

SEQ ID NO: 610 - protein, 8 aa, Artificial Sequence
  Cyclicized modulating agent comprising desomglein cell adhesion recognition sequence
KINRNTGE

SEQ ID NO: 611 - protein, 7 aa, Artificial Sequence
  Cyclicized modulating agent comprising desomglein cell adhesion recognition sequence
KIINRNE

SEQ ID NO: 612 - protein, 8 aa, Artificial Sequence
  Cyclicized modulating agent comprising desomglein cell adhesion recognition sequence
KIINRNTE

SEQ ID NO: 613 - protein, 9 aa, Artificial Sequence
  Cyclicized modulating agent comprising desomglein cell adhesion recognition sequence
KIINRNTGE

SEQ ID NO: 614 - protein, 8 aa, Artificial Sequence
  Cyclicized modulating agent comprising desomglein cell adhesion recognition sequence
KFIINRNE

SEQ ID NO: 615 - protein, 9 aa, Artificial Sequence
  Cyclicized modulating agent comprising desomglein cell adhesion recognition sequence
KFIINRNTE

SEQ ID NO: 616 - protein, 10 aa, Artificial Sequence
  Cyclicized modulating agent comprising desomglein cell adhesion recognition sequence
KFIINRNTGE

SEQ ID NO: 617 - protein, 9 aa, Artificial Sequence
  Cyclicized modulating agent comprising desomglein cell adhesion recognition sequence
KMFIINRNE

SEQ ID NO: 618 - protein, 10 aa, Artificial Sequence
  Cyclicized modulating agent comprising desomglein cell adhesion recognition sequence
KMFIINRNTE

SEQ ID NO: 619 - protein, 11 aa, Artificial Sequence
  Cyclicized modulating agent comprising desomglein cell adhesion recognition sequence
KMFIINRNTGE

SEQ ID NO: 620 - protein, 5 aa, Artificial Sequence
  Cyclicized modulating agent comprising desomglein cell adhesion recognition sequence
KNKDE

SEQ ID NO: 621 - protein, 6 aa, Artificial Sequence
  Cyclicized modulating agent comprising desomglein cell adhesion recognition sequence
KNKDTE

SEQ ID NO: 622 - protein, 7 aa, Artificial Sequence
  Cyclicized modulating agent comprising desomglein cell adhesion recognition sequence
KNKDTGE

SEQ ID NO: 623 - protein, 6 aa, Artificial Sequence
  Cyclicized modulating agent comprising desomglein cell adhesion recognition sequence
KLNKDE

SEQ ID NO: 624 - protein, 7 aa, Artificial Sequence
  Cyclicized modulating agent comprising desomglein cell adhesion recognition sequence
KLNKDTE

SEQ ID NO: 625 - protein, 8 aa, Artificial Sequence
  Cyclicized modulating agent comprising desomglein cell adhesion recognition sequence
KLNKDTGE

SEQ ID NO: 626 - protein, 7 aa, Artificial Sequence
  Cyclicized modulating agent comprising desomglein cell adhesion recognition sequence
KYLNKDE

SEQ ID NO: 627 - protein, 8 aa, Artificial Sequence
  Cyclicized modulating agent comprising desomglein cell adhesion recognition sequence
KYLNKDTE

SEQ ID NO: 628 - protein, 9 aa, Artificial Sequence
  Cyclicized modulating agent comprising desomglein cell adhesion recognition sequence
KYLNKDTGE

SEQ ID NO: 629 - protein, 8 aa, Artificial Sequence
  Cyclicized modulating agent comprising desomglein cell adhesion recognition sequence
KFYLNKDE

SEQ ID NO: 630 - protein, 9 aa, Artificial Sequence
  Cyclicized modulating agent comprising desomglein cell adhesion recognition sequence
KFYLNKDTE

SEQ ID NO: 631 - protein, 10 aa, Artificial Sequence
  Cyclicized modulating agent comprising desomglein cell adhesion recognition sequence
KFYLNKDTGE

SEQ ID NO: 632 - protein, 9 aa, Artificial Sequence
  Cyclicized modulating agent comprising desomglein cell adhesion recognition sequence
KVFYLNKDE

SEQ ID NO: 633 - protein, 10 aa, Artificial Sequence
  Cyclicized modulating agent comprising desomglein cell adhesion recognition sequence
KVFYLNKDTE

SEQ ID NO: 634 - protein, 11 aa, Artificial Sequence
  Cyclicized modulating agent comprising desomglein cell adhesion recognition sequence
KVFYLNKDTGE

SEQ ID NO: 635 - protein, 5 aa, Artificial Sequence
  Cyclicized modulating agent comprising desomglein cell adhesion recognition sequence
NQKTG

SEQ ID NO: 636 - protein, 5 aa, Artificial Sequence
  Cyclicized modulating agent comprising desomglein cell adhesion recognition sequence
INQKT

SEQ ID NO: 637 - protein, 6 aa, Artificial Sequence
  Cyclicized modulating agent comprising desomglein cell adhesion recognition sequence
INQKTG

SEQ ID NO: 638 - protein, 5 aa, Artificial Sequence
  Cyclicized modulating agent comprising desomglein cell adhesion recognition sequence
VINQK

SEQ ID NO: 639 - protein, 6 aa, Artificial Sequence
  Cyclicized modulating agent comprising desomglein cell adhesion recognition sequence
VINQKT

SEQ ID NO: 640 - protein, 7 aa, Artificial Sequence
  Cyclicized modulating agent comprising desomglein cell adhesion recognition sequence
VINQKTG

SEQ ID NO: 641 - protein, 6 aa, Artificial Sequence
  Cyclicized modulating agent comprising desomglein cell adhesion recognition sequence
FVINQK

SEQ ID NO: 642 - protein, 7 aa, Artificial Sequence
  Cyclicized modulating agent comprising desomglein cell adhesion recognition sequence
FVINQKT

SEQ ID NO: 643 - protein, 8 aa, Artificial Sequence
  Cyclicized modulating agent comprising desomglein cell adhesion recognition sequence
FVINQKTG

SEQ ID NO: 644 - protein, 7 aa, Artificial Sequence
  Cyclicized modulating agent comprising desomglein cell adhesion recognition sequence
IFVINQK

SEQ ID NO: 645 - protein, 8 aa, Artificial Sequence
  Cyclicized modulating agent comprising desomglein cell adhesion recognition sequence
IFVINQKT

SEQ ID NO: 646 - protein, 9 aa, Artificial Sequence
  Cyclicized modulating agent comprising desomglein cell adhesion recognition sequence
IFVINQKTG

SEQ ID NO: 647 - protein, 5 aa, Artificial Sequence
  Cyclicized modulating agent comprising desomglein cell adhesion recognition sequence
NRNTG

SEQ ID NO: 648 - protein, 5 aa, Artificial Sequence
  Cyclicized modulating agent comprising desomglein cell adhesion recognition sequence
INRNT

SEQ ID NO: 649 - protein, 6 aa, Artificial Sequence
  Cyclicized modulating agent comprising desomglein cell adhesion recognition sequence
INRNTG

SEQ ID NO: 650 - protein, 5 aa, Artificial Sequence
  Cyclicized modulating agent comprising desomglein cell adhesion recognition sequence
IINRN

SEQ ID NO: 651 - protein, 6 aa, Artificial Sequence
  Cyclicized modulating agent comprising desomglein cell adhesion recognition sequence
IINRNT

SEQ ID NO: 652 - protein, 7 aa, Artificial Sequence
  Cyclicized modulating agent comprising desomglein cell adhesion recognition sequence
IINRNTG

SEQ ID NO: 653 - protein, 6 aa, Artificial Sequence
  Cyclicized modulating agent comprising desomglein cell adhesion recognition sequence
FIINRN

SEQ ID NO: 654 - protein, 7 aa, Artificial Sequence
  Cyclicized modulating agent comprising desomglein cell adhesion recognition sequence
FIINRNT

SEQ ID NO: 655 - protein, 8 aa, Artificial Sequence
  Cyclicized modulating agent comprising desomglein cell adhesion recognition sequence
FIINRNTG

SEQ ID NO: 656 - protein, 7 aa, Artificial Sequence
  Cyclicized modulating agent comprising desomglein cell adhesion recognition sequence
MFIINRN

SEQ ID NO: 657 - protein, 8 aa, Artificial Sequence
  Cyclicized modulating agent comprising desomglein cell adhesion recognition sequence
MFIINRNT

SEQ ID NO: 658 - protein, 9 aa, Artificial Sequence
  Cyclicized modulating agent comprising desomglein cell adhesion recognition sequence
MFIINRNTG

SEQ ID NO: 659 - protein, 5 aa, Artificial Sequence
  Cyclicized modulating agent comprising desomglein cell adhesion recognition sequence
NKDTG

SEQ ID NO: 660 - protein, 5 aa, Artificial Sequence
  Cyclicized modulating agent comprising desomglein cell adhesion recognition sequence
LNKDT

SEQ ID NO: 661 - protein, 6 aa, Artificial Sequence
  Cyclicized modulating agent comprising desomglein cell adhesion recognition sequence
LNKDTG

SEQ ID NO: 662 - protein, 5 aa, Artificial Sequence
  Cyclicized modulating agent comprising desomglein cell adhesion recognition sequence
YLNKD

SEQ ID NO: 663 - protein, 6 aa, Artificial Sequence
  Cyclicized modulating agent comprising desomglein cell adhesion recognition sequence
YLNKDT

SEQ ID NO: 664 - protein, 7 aa, Artificial Sequence
  Cyclicized modulating agent comprising desomglein cell adhesion recognition sequence
YLNKDTG

SEQ ID NO: 665 - protein, 6 aa, Artificial Sequence
  Cyclicized modulating agent comprising desomglein cell adhesion recognition sequence
FYLNKD

SEQ ID NO: 666 - protein, 7 aa, Artificial Sequence
  Cyclicized modulating agent comprising desomglein cell adhesion recognition sequence
FYLNKDT

SEQ ID NO: 667 - protein, 8 aa, Artificial Sequence
  Cyclicized modulating agent comprising desomglein cell adhesion recognition sequence
FYLNKDTG

SEQ ID NO: 668 - protein, 7 aa, Artificial Sequence
  Cyclicized modulating agent comprising desomglein cell adhesion recognition sequence
VFYLNKD

SEQ ID NO: 669 - protein, 8 aa, Artificial Sequence
  Cyclicized modulating agent comprising desomglein cell adhesion recognition sequence
VFYLNKDT

SEQ ID NO: 670 - protein, 9 aa, Artificial Sequence
  Cyclicized modulating agent comprising desomglein cell adhesion recognition sequence
VFYLNKDTG

SEQ ID NO: 671 - protein, 5 aa, Artificial Sequence
  Cyclicized modulating agent comprising desmocollin cell adhesion recognition sequence
CEKDC

SEQ ID NO: 672 - protein, 6 aa, Artificial Sequence
  Cyclicized modulating agent comprising desmocollin cell adhesion recognition sequence
CEKDTC

SEQ ID NO: 673 - protein, 7 aa, Artificial Sequence
  Cyclicized modulating agent comprising desmocollin cell adhesion recognition sequence
CEKDTGC

SEQ ID NO: 674 - protein, 6 aa, Artificial Sequence
  Cyclicized modulating agent comprising desmocollin cell adhesion recognition sequence
CIEKDC

SEQ ID NO: 675 - protein, 7 aa, Artificial Sequence
  Cyclicized modulating agent comprising desmocollin cell adhesion recognition sequence
CIEKDTC

SEQ ID NO: 676 - protein, 8 aa, Artificial Sequence
  Cyclicized modulating agent comprising desmocollin cell adhesion recognition sequence
CIEKDTGC

SEQ ID NO: 677 - protein, 7 aa, Artificial Sequence
  Cyclicized modulating agent comprising desmocollin cell adhesion recognition sequence
CYIEKDC

SEQ ID NO: 678 - protein, 8 aa, Artificial Sequence
  Cyclicized modulating agent comprising desmocollin cell adhesion recognition sequence
CYIEKDTC

SEQ ID NO: 679 - protein, 9 aa, Artificial Sequence
  Cyclicized modulating agent comprising desmocollin cell adhesion recognition sequence
CYIEKDTGC

SEQ ID NO: 680 - protein, 8 aa, Artificial Sequence
  Cyclicized modulating agent comprising desmocollin cell adhesion recognition sequence
CFYIEKDC

SEQ ID NO: 681 - protein, 9 aa, Artificial Sequence
  Cyclicized modulating agent comprising desmocollin cell adhesion recognition sequence
CFYIEKDTC

SEQ ID NO: 682 - protein, 10 aa, Artificial Sequence
  Cyclicized modulating agent comprising desmocollin cell adhesion recognition sequence
CFYIEKDTGC

SEQ ID NO: 683 - protein, 9 aa, Artificial Sequence
  Cyclicized modulating agent comprising desmocollin cell adhesion recognition sequence
CLFYIEKDC

SEQ ID NO: 684 - protein, 10 aa, Artificial Sequence
  Cyclicized modulating agent comprising desmocollin cell adhesion recognition sequence
CLFYIEKDTC

SEQ ID NO: 685 - protein, 11 aa, Artificial Sequence
  Cyclicized modulating agent comprising desmocollin cell adhesion recognition sequence
CLFYIEKDTGC

SEQ ID NO: 686 - protein, 5 aa, Artificial Sequence
  Cyclicized modulating agent comprising desmocollin cell adhesion recognition sequence
CERDC

SEQ ID NO: 687 - protein, 6 aa, Artificial Sequence
  Cyclicized modulating agent comprising desmocollin cell adhesion recognition sequence
CERDTC

SEQ ID NO: 688 - protein, 7 aa, Artificial Sequence
  Cyclicized modulating agent comprising desmocollin cell adhesion recognition sequence
CERDTGC

SEQ ID NO: 689 - protein, 6 aa, Artificial Sequence
  Cyclicized modulating agent comprising desmocollin cell adhesion recognition sequence
CVERDC

SEQ ID NO: 690 - protein, 7 aa, Artificial Sequence
  Cyclicized modulating agent comprising desmocollin cell adhesion recognition sequence
CVERDTC

SEQ ID NO: 691 - protein, 8 aa, Artificial Sequence
  Cyclicized modulating agent comprising desmocollin cell adhesion recognition sequence
CVERDTGC

SEQ ID NO: 692 - protein, 7 aa, Artificial Sequence
  Cyclicized modulating agent comprising desmocollin cell adhesion recognition sequence
CYVERDC

SEQ ID NO: 693 - protein, 8 aa, Artificial Sequence
  Cyclicized modulating agent comprising desmocollin cell adhesion recognition sequence
CYVERDTC

SEQ ID NO: 694 - protein, 9 aa, Artificial Sequence
  Cyclicized modulating agent comprising desmocollin cell adhesion recognition sequence
CYVERDTGC

SEQ ID NO: 695 - protein, 8 aa, Artificial Sequence
  Cyclicized modulating agent comprising desmocollin cell adhesion recognition sequence
CFYVERDC

SEQ ID NO: 696 - protein, 9 aa, Artificial Sequence
  Cyclicized modulating agent comprising desmocollin cell adhesion recognition sequence
CFYVERDTC

SEQ ID NO: 697 - protein, 10 aa, Artificial Sequence
  Cyclicized modulating agent comprising desmocollin cell adhesion recognition sequence
CFYVERDTGC

SEQ ID NO: 698 - protein, 9 aa, Artificial Sequence
  Cyclicized modulating agent comprising desmocollin cell adhesion recognition sequence
CLFYVERDC

SEQ ID NO: 699 - protein, 10 aa, Artificial Sequence
  Cyclicized modulating agent comprising desmocollin cell adhesion recognition sequence
CLFYVERDTC

SEQ ID NO: 700 - protein, 11 aa, Artificial Sequence
  Cyclicized modulating agent comprising desmocollin cell adhesion recognition sequence
CLFYVERDTGC

SEQ ID NO: 701 - protein, 6 aa, Artificial Sequence
  Cyclicized modulating agent comprising desmocollin cell adhesion recognition sequence
CIERDC

SEQ ID NO: 702 - protein, 7 aa, Artificial Sequence
  Cyclicized modulating agent comprising desmocollin cell adhesion recognition sequence
CIERDTC

SEQ ID NO: 703 - protein, 8 aa, Artificial Sequence
  Cyclicized modulating agent comprising desmocollin cell adhesion recognition sequence
CIERDTGC

SEQ ID NO: 704 - protein, 7 aa, Artificial Sequence
  Cyclicized modulating agent comprising desmocollin cell adhesion recognition sequence
CYIERDC

SEQ ID NO: 705 - protein, 8 aa, Artificial Sequence
  Cyclicized modulating agent comprising desmocollin cell adhesion recognition sequence
CYIERDTC

SEQ ID NO: 706 - protein, 9 aa, Artificial Sequence
  Cyclicized modulating agent comprising desmocollin cell adhesion recognition sequence
CYIERDTGC

SEQ ID NO: 707 - protein, 8 aa, Artificial Sequence
  Cyclicized modulating agent comprising desmocollin cell adhesion recognition sequence
CFYIERDC

SEQ ID NO: 708 - protein, 9 aa, Artificial Sequence
  Cyclicized modulating agent comprising desmocollin cell adhesion recognition sequence
CFYIERDTC

SEQ ID NO: 709 - protein, 10 aa, Artificial Sequence
  Cyclicized modulating agent comprising desmocollin cell adhesion recognition sequence
CFYIERDTGC

SEQ ID NO: 710 - protein, 9 aa, Artificial Sequence
  Cyclicized modulating agent comprising desmocollin cell adhesion recognition sequence
CLFYIERDC

SEQ ID NO: 711 - protein, 10 aa, Artificial Sequence
  Cyclicized modulating agent comprising desmocollin cell adhesion recognition sequence
CLFYIERDTC

SEQ ID NO: 712 - protein, 11 aa, Artificial Sequence
  Cyclicized modulating agent comprising desmocollin cell adhesion recognition sequence
CLFYIERDTGC

SEQ ID NO: 713 - protein, 5 aa, Artificial Sequence
  Cyclicized modulating agent comprising desmocollin cell adhesion recognition sequence
EEKDK

SEQ ID NO: 714 - protein, 6 aa, Artificial Sequence
  Cyclicized modulating agent comprising desmocollin cell adhesion recognition sequence
EEKDTK

SEQ ID NO: 715 - protein, 7 aa, Artificial Sequence
  Cyclicized modulating agent comprising desmocollin cell adhesion recognition sequence
EEKDTGK

SEQ ID NO: 716 - protein, 6 aa, Artificial Sequence
  Cyclicized modulating agent comprising desmocollin cell adhesion recognition sequence
EIEKDK

SEQ ID NO: 717 - protein, 7 aa, Artificial Sequence
  Cyclicized modulating agent comprising desmocollin cell adhesion recognition sequence
EIEKDTK

SEQ ID NO: 718 - protein, 8 aa, Artificial Sequence
  Cyclicized modulating agent comprising desmocollin cell adhesion recognition sequence
EIEKDTGK

SEQ ID NO: 719 - protein, 7 aa, Artificial Sequence
  Cyclicized modulating agent comprising desmocollin cell adhesion recognition sequence
EYIEKDK

SEQ ID NO: 720 - protein, 8 aa, Artificial Sequence
  Cyclicized modulating agent comprising desmocollin cell adhesion recognition sequence
EYIEKDTK

SEQ ID NO: 721 - protein, 9 aa, Artificial Sequence
  Cyclicized modulating agent comprising desmocollin cell adhesion recognition sequence
EYIEKDTGK

SEQ ID NO: 722 - protein, 8 aa, Artificial Sequence
  Cyclicized modulating agent comprising desmocollin cell adhesion recognition sequence
EFYIEKDK

SEQ ID NO: 723 - protein, 9 aa, Artificial Sequence
  Cyclicized modulating agent comprising desmocollin cell adhesion recognition sequence
EFYIEKDTK

SEQ ID NO: 724 - protein, 10 aa, Artificial Sequence
  Cyclicized modulating agent comprising desmocollin cell adhesion recognition sequence
EFYIEKDTGK

SEQ ID NO: 725 - protein, 9 aa, Artificial Sequence
  Cyclicized modulating agent comprising desmocollin cell adhesion recognition sequence
ELFYIEKDK

SEQ ID NO: 726 - protein, 10 aa, Artificial Sequence
  Cyclicized modulating agent comprising desmocollin cell adhesion recognition sequence
ELFYIEKDTK

SEQ ID NO: 727 - protein, 11 aa, Artificial Sequence
  Cyclicized modulating agent comprising desmocollin cell adhesion recognition sequence
ELFYIEKDTGK

SEQ ID NO: 728 - protein, 5 aa, Artificial Sequence
  Cyclicized modulating agent comprising desmocollin cell adhesion recognition sequence
EERDK

SEQ ID NO: 729 - protein, 6 aa, Artificial Sequence
  Cyclicized modulating agent comprising desmocollin cell adhesion recognition sequence
EERDTK

SEQ ID NO: 730 - protein, 7 aa, Artificial Sequence
  Cyclicized modulating agent comprising desmocollin cell adhesion recognition sequence
EERDTGK

SEQ ID NO: 731 - protein, 6 aa, Artificial Sequence
  Cyclicized modulating agent comprising desmocollin cell adhesion recognition sequence
EVERDK

SEQ ID NO: 732 - protein, 7 aa, Artificial Sequence
  Cyclicized modulating agent comprising desmocollin cell adhesion recognition sequence
EVERDTK

SEQ ID NO: 733 - protein, 8 aa, Artificial Sequence
  Cyclicized modulating agent comprising desmocollin cell adhesion recognition sequence
EVERDTGK

SEQ ID NO: 734 - protein, 7 aa, Artificial Sequence
  Cyclicized modulating agent comprising desmocollin cell adhesion recognition sequence
EYVERDK

SEQ ID NO: 735 - protein, 7 aa, Artificial Sequence
  Cyclicized modulating agent comprising desmocollin cell adhesion recognition sequence
YVERDTK

SEQ ID NO: 736 - protein, 9 aa, Artificial Sequence
  Cyclicized modulating agent comprising desmocollin cell adhesion recognition sequence
EYVERDTGK

SEQ ID NO: 737 - protein, 8 aa, Artificial Sequence
  Cyclicized modulating agent comprising desmocollin cell adhesion recognition sequence
EFYVERDK

SEQ ID NO: 738 - protein, 9 aa, Artificial Sequence
  Cyclicized modulating agent comprising desmocollin cell adhesion recognition sequence
EFYVERDTK

SEQ ID NO: 739 - protein, 10 aa, Artificial Sequence
  Cyclicized modulating agent comprising desmocollin cell adhesion recognition sequence
EFYVERDTGK

SEQ ID NO: 740 - protein, 9 aa, Artificial Sequence
  Cyclicized modulating agent comprising desmocollin cell adhesion recognition sequence
ELFYVERDK

SEQ ID NO: 741 - protein, 10 aa, Artificial Sequence
  Cyclicized modulating agent comprising desmocollin cell adhesion recognition sequence
ELFYVERDTK

SEQ ID NO: 742 - protein, 11 aa, Artificial Sequence
  Cyclicized modulating agent comprising desmocollin cell adhesion recognition sequence
ELFYVERDTGK

SEQ ID NO: 743 - protein, 6 aa, Artificial Sequence
  Cyclicized modulating agent comprising desmocollin cell adhesion recognition sequence
EIERDK

SEQ ID NO: 744 - protein, 7 aa, Artificial Sequence
  Cyclicized modulating agent comprising desmocollin cell adhesion recognition sequence
EIERDTK

SEQ ID NO: 745 - protein, 8 aa, Artificial Sequence
  Cyclicized modulating agent comprising desmocollin cell adhesion recognition sequence
EIERDTGK

SEQ ID NO: 746 - protein, 7 aa, Artificial Sequence
  Cyclicized modulating agent comprising desmocollin cell adhesion recognition sequence
EYIERDK

SEQ ID NO: 747 - protein, 8 aa, Artificial Sequence
  Cyclicized modulating agent comprising desmocollin cell adhesion recognition sequence
EYIERDTK

SEQ ID NO: 748 - protein, 9 aa, Artificial Sequence
  Cyclicized modulating agent comprising desmocollin cell adhesion recognition sequence
EYIERDTGK

SEQ ID NO: 749 - protein, 8 aa, Artificial Sequence
  Cyclicized modulating agent comprising desmocollin cell adhesion recognition sequence
EFYIERDK

SEQ ID NO: 750 - protein, 9 aa, Artificial Sequence
  Cyclicized modulating agent comprising desmocollin cell adhesion recognition sequence
EFYIERDTK

SEQ ID NO: 751 - protein, 10 aa, Artificial Sequence
  Cyclicized modulating agent comprising desmocollin cell adhesion recognition sequence
EFYIERDTGK

SEQ ID NO: 752 - protein, 9 aa, Artificial Sequence
  Cyclicized modulating agent comprising desmocollin cell adhesion recognition sequence
ELFYIERDK

SEQ ID NO: 753 - protein, 10 aa, Artificial Sequence
  Cyclicized modulating agent comprising desmocollin cell adhesion recognition sequence
ELFYIERDTK

SEQ ID NO: 754 - protein, 11 aa, Artificial Sequence
  Cyclicized modulating agent comprising desmocollin cell adhesion recognition sequence
ELFYIERDTGK

SEQ ID NO: 755 - protein, 5 aa, Artificial Sequence
  Cyclicized modulating agent comprising desmocollin cell adhesion recognition sequence
KEKDD

SEQ ID NO: 756 - protein, 6 aa, Artificial Sequence
  Cyclicized modulating agent comprising desmocollin cell adhesion recognition sequence
KEKDTD

SEQ ID NO: 757 - protein, 7 aa, Artificial Sequence
  Cyclicized modulating agent comprising desmocollin cell adhesion recognition sequence
KEKDTGD

SEQ ID NO: 758 - protein, 6 aa, Artificial Sequence
  Cyclicized modulating agent comprising desmocollin cell adhesion recognition sequence
KIEKDD

SEQ ID NO: 759 - protein, 7 aa, Artificial Sequence
  Cyclicized modulating agent comprising desmocollin cell adhesion recognition sequence
KIEKDTD

SEQ ID NO: 760 - protein, 8 aa, Artificial Sequence
  Cyclicized modulating agent comprising desmocollin cell adhesion recognition sequence
KIEKDTGD

SEQ ID NO: 761 - protein, 7 aa, Artificial Sequence
  Cyclicized modulating agent comprising desmocollin cell adhesion recognition sequence
KYIEKDD

SEQ ID NO: 762 - protein, 8 aa, Artificial Sequence
  Cyclicized modulating agent comprising desmocollin cell adhesion recognition sequence
KYIEKDTD

SEQ ID NO: 763 - protein, 9 aa, Artificial Sequence
  Cyclicized modulating agent comprising desmocollin cell adhesion recognition sequence
KYIEKDTGD

SEQ ID NO: 764 - protein, 8 aa, Artificial Sequence
  Cyclicized modulating agent comprising desmocollin cell adhesion recognition sequence
KFYIEKDD

SEQ ID NO: 765 - protein, 9 aa, Artificial Sequence
  Cyclicized modulating agent comprising desmocollin cell adhesion recognition sequence
KFYIEKDTD

SEQ ID NO: 766 - protein, 10 aa, Artificial Sequence
  Cyclicized modulating agent comprising desmocollin cell adhesion recognition sequence
KFYIEKDTGD

SEQ ID NO: 767 - protein, 9 aa, Artificial Sequence
  Cyclicized modulating agent comprising desmocollin cell adhesion recognition sequence
KLFYIEKDD

SEQ ID NO: 768 - protein, 10 aa, Artificial Sequence
  Cyclicized modulating agent comprising desmocollin cell adhesion recognition sequence
KLFYIEKDTD

SEQ ID NO: 769 - protein, 11 aa, Artificial Sequence
  Cyclicized modulating agent comprising desmocollin cell adhesion recognition sequence
KLFYIEKDTGD

SEQ ID NO: 770 - protein, 5 aa, Artificial Sequence
  Cyclicized modulating agent comprising desmocollin cell adhesion recognition sequence
KERDD

SEQ ID NO: 771 - protein, 6 aa, Artificial Sequence
  Cyclicized modulating agent comprising desmocollin cell adhesion recognition sequence
KERDTD

SEQ ID NO: 772 - protein, 7 aa, Artificial Sequence
  Cyclicized modulating agent comprising desmocollin cell adhesion recognition sequence
KERDTGD

SEQ ID NO: 773 - protein, 6 aa, Artificial Sequence
  Cyclicized modulating agent comprising desmocollin cell adhesion recognition sequence
KVERDD

SEQ ID NO: 774 - protein, 7 aa, Artificial Sequence
  Cyclicized modulating agent comprising desmocollin cell adhesion recognition sequence
KVERDTD

SEQ ID NO: 775 - protein, 8 aa, Artificial Sequence
  Cyclicized modulating agent comprising desmocollin cell adhesion recognition sequence
KVERDTGD

SEQ ID NO: 776 - protein, 7 aa, Artificial Sequence
  Cyclicized modulating agent comprising desmocollin cell adhesion recognition sequence
KYVERDD

SEQ ID NO: 777 - protein, 8 aa, Artificial Sequence
  Cyclicized modulating agent comprising desmocollin cell adhesion recognition sequence
KYVERDTD

SEQ ID NO: 778 - protein, 9 aa, Artificial Sequence
  Cyclicized modulating agent comprising desmocollin cell adhesion recognition sequence
KYVERDTGD

SEQ ID NO: 779 - protein, 8 aa, Artificial Sequence
  Cyclicized modulating agent comprising desmocollin cell adhesion recognition sequence
KFYVERDD

SEQ ID NO: 780 - protein, 9 aa, Artificial Sequence
  Cyclicized modulating agent comprising desmocollin cell adhesion recognition sequence
KFYVERDTD

SEQ ID NO: 781 - protein, 10 aa, Artificial Sequence
  Cyclicized modulating agent comprising desmocollin cell adhesion recognition sequence
KFYVERDTGD

SEQ ID NO: 782 - protein, 9 aa, Artificial Sequence
  Cyclicized modulating agent comprising desmocollin cell adhesion recognition sequence
KLFYVERDD

SEQ ID NO: 783 - protein, 10 aa, Artificial Sequence
  Cyclicized modulating agent comprising desmocollin cell adhesion recognition sequence
KLFYVERDTD

SEQ ID NO: 784 - protein, 11 aa, Artificial Sequence
  Cyclicized modulating agent comprising desmocollin cell adhesion recognition sequence
KLFYVERDTGD

SEQ ID NO: 785 - protein, 6 aa, Artificial Sequence
  Cyclicized modulating agent comprising desmocollin cell adhesion recognition sequence
KIERDD

SEQ ID NO: 786 - protein, 7 aa, Artificial Sequence
  Cyclicized modulating agent comprising desmocollin cell adhesion recognition sequence
KIERDTD

SEQ ID NO: 787 - protein, 8 aa, Artificial Sequence
  Cyclicized modulating agent comprising desmocollin cell adhesion recognition sequence
KIERDTGD

SEQ ID NO: 788 - protein, 6 aa, Artificial Sequence
  Cyclicized modulating agent comprising desmocollin cell adhesion recognition sequence
KYIERD

SEQ ID NO: 789 - protein, 8 aa, Artificial Sequence
  Cyclicized modulating agent comprising desmocollin cell adhesion recognition sequence
KYIERDTD

SEQ ID NO: 790 - protein, 9 aa, Artificial Sequence
  Cyclicized modulating agent comprising desmocollin cell adhesion recognition sequence
KYIERDTGD

SEQ ID NO: 791 - protein, 8 aa, Artificial Sequence
  Cyclicized modulating agent comprising desmocollin cell adhesion recognition sequence
KFYIERDD

SEQ ID NO: 792 - protein, 9 aa, Artificial Sequence
  Cyclicized modulating agent comprising desmocollin cell adhesion recognition sequence
KFYIERDTD

SEQ ID NO: 793 - protein, 10 aa, Artificial Sequence
  Cyclicized modulating agent comprising desmocollin cell adhesion recognition sequence
KFYIERDTGD

SEQ ID NO: 794 - protein, 9 aa, Artificial Sequence
  Cyclicized modulating agent comprising desmocollin cell adhesion recognition sequence
KLFYIERDD

SEQ ID NO: 795 - protein, 10 aa, Artificial Sequence
  Cyclicized modulating agent comprising desmocollin cell adhesion recognition sequence
KLFYIERDTD

SEQ ID NO: 796 - protein, 11 aa, Artificial Sequence
  Cyclicized modulating agent comprising desmocollin cell adhesion recognition sequence
KLFYIERDTGD

SEQ ID NO: 797 - protein, 5 aa, Artificial Sequence
  Cyclicized modulating agent comprising desmocollin cell adhesion recognition sequence
DEKDK

SEQ ID NO: 798 - protein, 6 aa, Artificial Sequence
  Cyclicized modulating agent comprising desmocollin cell adhesion recognition sequence
DEKDTK

SEQ ID NO: 799 - protein, 7 aa, Artificial Sequence
  Cyclicized modulating agent comprising desmocollin cell adhesion recognition sequence
DEKDTGK

SEQ ID NO: 800 - protein, 6 aa, Artificial Sequence
  Cyclicized modulating agent comprising desmocollin cell adhesion recognition sequence
DIEKDK

SEQ ID NO: 801 - protein, 7 aa, Artificial Sequence
  Cyclicized modulating agent comprising desmocollin cell adhesion recognition sequence
DIEKDTK

SEQ ID NO: 802 - protein, 8 aa, Artificial Sequence
  Cyclicized modulating agent comprising desmocollin cell adhesion recognition sequence
DIEKDTGK

SEQ ID NO: 803 - protein, 7 aa, Artificial Sequence
  Cyclicized modulating agent comprising desmocollin cell adhesion recognition sequence
DYIEKDK

SEQ ID NO: 804 - protein, 8 aa, Artificial Sequence
  Cyclicized modulating agent comprising desmocollin cell adhesion recognition sequence
DYIEKDTK

SEQ ID NO: 805 - protein, 9 aa, Artificial Sequence
  Cyclicized modulating agent comprising desmocollin cell adhesion recognition sequence
DYIEKDTGK

SEQ ID NO: 806 - protein, 8 aa, Artificial Sequence
  Cyclicized modulating agent comprising desmocollin cell adhesion recognition sequence
DFYIEKDK

SEQ ID NO: 807 - protein, 9 aa, Artificial Sequence
  Cyclicized modulating agent comprising desmocollin cell adhesion recognition sequence
DFYIEKDTK

SEQ ID NO: 808 - protein, 10 aa, Artificial Sequence
  Cyclicized modulating agent comprising desmocollin cell adhesion recognition sequence
DFYIEKDTGK

SEQ ID NO: 809 - protein, 9 aa, Artificial Sequence
  Cyclicized modulating agent comprising desmocollin cell adhesion recognition sequence
DLFYIEKDK

SEQ ID NO: 810 - protein, 10 aa, Artificial Sequence
  Cyclicized modulating agent comprising desmocollin cell adhesion recognition sequence
DLFYIEKDTK

SEQ ID NO: 811 - protein, 11 aa, Artificial Sequence
  Cyclicized modulating agent comprising desmocollin cell adhesion recognition sequence
DLFYIEKDTGK

SEQ ID NO: 812 - protein, 5 aa, Artificial Sequence
  Cyclicized modulating agent comprising desmocollin cell adhesion recognition sequence
DERDK

SEQ ID NO: 813 - protein, 6 aa, Artificial Sequence
  Cyclicized modulating agent comprising desmocollin cell adhesion recognition sequence
DERDTK

SEQ ID NO: 814 - protein, 7 aa, Artificial Sequence
  Cyclicized modulating agent comprising desmocollin cell adhesion recognition sequence
DERDTGK

SEQ ID NO: 815 - protein, 6 aa, Artificial Sequence
  Cyclicized modulating agent comprising desmocollin cell adhesion recognition sequence
DVERDK

SEQ ID NO: 816 - protein, 7 aa, Artificial Sequence
  Cyclicized modulating agent comprising desmocollin cell adhesion recognition sequence
DVERDTK

SEQ ID NO: 817 - protein, 8 aa, Artificial Sequence
  Cyclicized modulating agent comprising desmocollin cell adhesion recognition sequence
DVERDTGK

SEQ ID NO: 818 - protein, 7 aa, Artificial Sequence
  Cyclicized modulating agent comprising desmocollin cell adhesion recognition sequence
DYVERDK

SEQ ID NO: 819 - protein, 8 aa, Artificial Sequence
  Cyclicized modulating agent comprising desmocollin cell adhesion recognition sequence
DYVERDTK

SEQ ID NO: 820 - protein, 9 aa, Artificial Sequence
  Cyclicized modulating agent comprising desmocollin cell adhesion recognition sequence
DYVERDTGK

SEQ ID NO: 821 - protein, 8 aa, Artificial Sequence
  Cyclicized modulating agent comprising desmocollin cell adhesion recognition sequence
DFYVERDK

SEQ ID NO: 822 - protein, 9 aa, Artificial Sequence
  Cyclicized modulating agent comprising desmocollin cell adhesion recognition sequence
DFYVERDTK

SEQ ID NO: 823 - protein, 10 aa, Artificial Sequence
  Cyclicized modulating agent comprising desmocollin cell adhesion recognition sequence
DFYVERDTGK

SEQ ID NO: 824 - protein, 9 aa, Artificial Sequence
  Cyclicized modulating agent comprising desmocollin cell adhesion recognition sequence
DLFYVERDK

SEQ ID NO: 825 - protein, 10 aa, Artificial Sequence
  Cyclicized modulating agent comprising desmocollin cell adhesion recognition sequence
DLFYVERDTK

SEQ ID NO: 826 - protein, 11 aa, Artificial Sequence
  Cyclicized modulating agent comprising desmocollin cell adhesion recognition sequence
DLFYVERDTGK

SEQ ID NO: 827 - protein, 6 aa, Artificial Sequence
  Cyclicized modulating agent comprising desmocollin cell adhesion recognition sequence
DIERDK

SEQ ID NO: 828 - protein, 7 aa, Artificial Sequence
  Cyclicized modulating agent comprising desmocollin cell adhesion recognition sequence
DIERDTK

SEQ ID NO: 829 - protein, 8 aa, Artificial Sequence
  Cyclicized modulating agent comprising desmocollin cell adhesion recognition sequence
DIERDTGK

SEQ ID NO: 830 - protein, 7 aa, Artificial Sequence
  Cyclicized modulating agent comprising desmocollin cell adhesion recognition sequence
DYIERDK

SEQ ID NO: 831 - protein, 8 aa, Artificial Sequence
  Cyclicized modulating agent comprising desmocollin cell adhesion recognition sequence
DYIERDTK

SEQ ID NO: 832 - protein, 9 aa, Artificial Sequence
  Cyclicized modulating agent comprising desmocollin cell adhesion recognition sequence
DYIERDTGK

SEQ ID NO: 833 - protein, 8 aa, Artificial Sequence
  Cyclicized modulating agent comprising desmocollin cell adhesion recognition sequence
DFYIERDK

SEQ ID NO: 834 - protein, 9 aa, Artificial Sequence
  Cyclicized modulating agent comprising desmocollin cell adhesion recognition sequence
DFYIERDTK

SEQ ID NO: 835 - protein, 10 aa, Artificial Sequence
  Cyclicized modulating agent comprising desmocollin cell adhesion recognition sequence
DFYIERDTGK

SEQ ID NO: 836 - protein, 9 aa, Artificial Sequence
  Cyclicized modulating agent comprising desmocollin cell adhesion recognition sequence
DLFYIERDK

SEQ ID NO: 837 - protein, 10 aa, Artificial Sequence
  Cyclicized modulating agent comprising desmocollin cell adhesion recognition sequence
DLFYIERDTK

SEQ ID NO: 838 - protein, 11 aa, Artificial Sequence
  Cyclicized modulating agent comprising desmocollin cell adhesion recognition sequence
DLFYIERDTGK

SEQ ID NO: 839 - protein, 5 aa, Artificial Sequence
  Cyclicized modulating agent comprising desmocollin cell adhesion recognition sequence
KEKDE

SEQ ID NO: 840 - protein, 6 aa, Artificial Sequence
  Cyclicized modulating agent comprising desmocollin cell adhesion recognition sequence
KEKDTE

SEQ ID NO: 841 - protein, 7 aa, Artificial Sequence
  Cyclicized modulating agent comprising desmocollin cell adhesion recognition sequence
KEKDTGE

SEQ ID NO: 842 - protein, 6 aa, Artificial Sequence
  Cyclicized modulating agent comprising desmocollin cell adhesion recognition sequence
KIEKDE

SEQ ID NO: 843 - protein, 7 aa, Artificial Sequence
  Cyclicized modulating agent comprising desmocollin cell adhesion recognition sequence
KIEKDTE

SEQ ID NO: 844 - protein, 8 aa, Artificial Sequence
  Cyclicized modulating agent comprising desmocollin cell adhesion recognition sequence
KIEKDTGE

SEQ ID NO: 845 - protein, 7 aa, Artificial Sequence
  Cyclicized modulating agent comprising desmocollin cell adhesion recognition sequence
KYIEKDE

SEQ ID NO: 846 - protein, 8 aa, Artificial Sequence
  Cyclicized modulating agent comprising desmocollin cell adhesion recognition sequence
KYIEKDTE

SEQ ID NO: 847 - protein, 9 aa, Artificial Sequence
  Cyclicized modulating agent comprising desmocollin cell adhesion recognition sequence
KYIEKDTGE

SEQ ID NO: 848 - protein, 8 aa, Artificial Sequence
  Cyclicized modulating agent comprising desmocollin cell adhesion recognition sequence
KFYIEKDE

SEQ ID NO: 849 - protein, 9 aa, Artificial Sequence
  Cyclicized modulating agent comprising desmocollin cell adhesion recognition sequence
KFYIEKDTE

SEQ ID NO: 850 - protein, 10 aa, Artificial Sequence
  Cyclicized modulating agent comprising desmocollin cell adhesion recognition sequence
KFYIEKDTGE

SEQ ID NO: 851 - protein, 9 aa, Artificial Sequence
  Cyclicized modulating agent comprising desmocollin cell adhesion recognition sequence
KLFYIEKDE

SEQ ID NO: 852 - protein, 10 aa, Artificial Sequence
  Cyclicized modulating agent comprising desmocollin cell adhesion recognition sequence
KLFYIEKDTE

SEQ ID NO: 853 - protein, 11 aa, Artificial Sequence
  Cyclicized modulating agent comprising desmocollin cell adhesion recognition sequence
KLFYIEKDTGE

SEQ ID NO: 854 - protein, 5 aa, Artificial Sequence
  Cyclicized modulating agent comprising desmocollin cell adhesion recognition sequence
KERDE

SEQ ID NO: 855 - protein, 6 aa, Artificial Sequence
  Cyclicized modulating agent comprising desmocollin cell adhesion recognition sequence
KERDTE

SEQ ID NO: 856 - protein, 7 aa, Artificial Sequence
  Cyclicized modulating agent comprising desmocollin cell adhesion recognition sequence
KERDTGE

SEQ ID NO: 857 - protein, 6 aa, Artificial Sequence
  Cyclicized modulating agent comprising desmocollin cell adhesion recognition sequence
KVERDE

SEQ ID NO: 858 - protein, 7 aa, Artificial Sequence
  Cyclicized modulating agent comprising desmocollin cell adhesion recognition sequence
KVERDTE

SEQ ID NO: 859 - protein, 8 aa, Artificial Sequence
  Cyclicized modulating agent comprising desmocollin cell adhesion recognition sequence
KVERDTGE

SEQ ID NO: 860 - protein, 7 aa, Artificial Sequence
  Cyclicized modulating agent comprising desmocollin cell adhesion recognition sequence
KYVERDE

SEQ ID NO: 861 - protein, 8 aa, Artificial Sequence
  Cyclicized modulating agent comprising desmocollin cell adhesion recognition sequence
KYVERDTE

SEQ ID NO: 862 - protein, 9 aa, Artificial Sequence
  Cyclicized modulating agent comprising desmocollin cell adhesion recognition sequence
KYVERDTGE

SEQ ID NO: 863 - protein, 8 aa, Artificial Sequence
  Cyclicized modulating agent comprising desmocollin cell adhesion recognition sequence
KFYVERDE

SEQ ID NO: 864 - protein, 9 aa, Artificial Sequence
  Cyclicized modulating agent comprising desmocollin cell adhesion recognition sequence
KFYVERDTE

SEQ ID NO: 865 - protein, 10 aa, Artificial Sequence
  Cyclicized modulating agent comprising desmocollin cell adhesion recognition sequence
KFYVERDTGE

SEQ ID NO: 866 - protein, 9 aa, Artificial Sequence
  Cyclicized modulating agent comprising desmocollin cell adhesion recognition sequence
KLFYVERDE

SEQ ID NO: 867 - protein, 10 aa, Artificial Sequence
  Cyclicized modulating agent comprising desmocollin cell adhesion recognition sequence
KLFYVERDTE

SEQ ID NO: 868 - protein, 11 aa, Artificial Sequence
  Cyclicized modulating agent comprising desmocollin cell adhesion recognition sequence
KLFYVERDTGE

SEQ ID NO: 869 - protein, 6 aa, Artificial Sequence
  Cyclicized modulating agent comprising desmocollin cell adhesion recognition sequence
KIERDE

SEQ ID NO: 870 - protein, 7 aa, Artificial Sequence
  Cyclicized modulating agent comprising desmocollin cell adhesion recognition sequence
KIERDTE

SEQ ID NO: 871 - protein, 8 aa, Artificial Sequence
  Cyclicized modulating agent comprising desmocollin cell adhesion recognition sequence
KIERDTGE

SEQ ID NO: 872 - protein, 7 aa, Artificial Sequence
  Cyclicized modulating agent comprising desmocollin cell adhesion recognition sequence
KYIERDE

SEQ ID NO: 873 - protein, 8 aa, Artificial Sequence
  Cyclicized modulating agent comprising desmocollin cell adhesion recognition sequence
KYIERDTE

SEQ ID NO: 874 - protein, 9 aa, Artificial Sequence
  Cyclicized modulating agent comprising desmocollin cell adhesion recognition sequence
KYIERDTGE

SEQ ID NO: 875 - protein, 8 aa, Artificial Sequence
  Cyclicized modulating agent comprising desmocollin cell adhesion recognition sequence
KFYIERDE

SEQ ID NO: 876 - protein, 9 aa, Artificial Sequence
  Cyclicized modulating agent comprising desmocollin cell adhesion recognition sequence
KFYIERDTE

SEQ ID NO: 877 - protein, 10 aa, Artificial Sequence
  Cyclicized modulating agent comprising desmocollin cell adhesion recognition sequence
KFYIERDTGE

SEQ ID NO: 878 - protein, 9 aa, Artificial Sequence
  Cyclicized modulating agent comprising desmocollin cell adhesion recognition sequence
KLFYIERDE

SEQ ID NO: 879 - protein, 10 aa, Artificial Sequence
  Cyclicized modulating agent comprising desmocollin cell adhesion recognition sequence
KLFYIERDTE

SEQ ID NO: 880 - protein, 11 aa, Artificial Sequence
  Cyclicized modulating agent comprising desmocollin cell adhesion recognition sequence
KLFYIERDTGE

SEQ ID NO: 881 - protein, 5 aa, Artificial Sequence
  Cyclicized modulating agent comprising desmocollin cell adhesion recognition sequence
EKDTG

SEQ ID NO: 882 - protein, 5 aa, Artificial Sequence
  Cyclicized modulating agent comprising desmocollin cell adhesion recognition sequence
IEKDT

SEQ ID NO: 883 - protein, 6 aa, Artificial Sequence
  Cyclicized modulating agent comprising desmocollin cell adhesion recognition sequence
IEKDTG

SEQ ID NO: 884 - protein, 5 aa, Artificial Sequence
  Cyclicized modulating agent comprising desmocollin cell adhesion recognition sequence
YIEKD

SEQ ID NO: 885 - protein, 6 aa, Artificial Sequence
  Cyclicized modulating agent comprising desmocollin cell adhesion recognition sequence
YIEKDT

SEQ ID NO: 886 - protein, 7 aa, Artificial Sequence
  Cyclicized modulating agent comprising desmocollin cell adhesion recognition sequence
YIEKDTG

SEQ ID NO: 887 - protein, 6 aa, Artificial Sequence
  Cyclicized modulating agent comprising desmocollin cell adhesion recognition sequence
FYIEKD

SEQ ID NO: 888 - protein, 7 aa, Artificial Sequence
  Cyclicized modulating agent comprising desmocollin cell adhesion recognition sequence
FYIEKDT

SEQ ID NO: 889 - protein, 8 aa, Artificial Sequence
  Cyclicized modulating agent comprising desmocollin cell adhesion recognition sequence
FYIEKDTG

SEQ ID NO: 890 - protein, 7 aa, Artificial Sequence
  Cyclicized modulating agent comprising desmocollin cell adhesion recognition sequence
LFYIEKD

SEQ ID NO: 891 - protein, 8 aa, Artificial Sequence
  Cyclicized modulating agent comprising desmocollin cell adhesion recognition sequence
LFYIEKDT

SEQ ID NO: 892 - protein, 9 aa, Artificial Sequence
  Cyclicized modulating agent comprising desmocollin cell adhesion recognition sequence
LFYIEKDTG

SEQ ID NO: 893 - protein, 5 aa, Artificial Sequence
  Cyclicized modulating agent comprising desmocollin cell adhesion recognition sequence
ERDTG

SEQ ID NO: 894 - protein, 5 aa, Artificial Sequence
  Cyclicized modulating agent comprising desmocollin cell adhesion recognition sequence
VERDT

SEQ ID NO: 895 - protein, 6 aa, Artificial Sequence
  Cyclicized modulating agent comprising desmocollin cell adhesion recognition sequence
VERDTG

SEQ ID NO: 896 - protein, 5 aa, Artificial Sequence
  Cyclicized modulating agent comprising desmocollin cell adhesion recognition sequence
YVERD

SEQ ID NO: 897 - protein, 6 aa, Artificial Sequence
  Cyclicized modulating agent comprising desmocollin cell adhesion recognition sequence
YVERDT

SEQ ID NO: 898 - protein, 7 aa, Artificial Sequence
  Cyclicized modulating agent comprising desmocollin cell adhesion recognition sequence
YVERDTG

SEQ ID NO: 899 - protein, 6 aa, Artificial Sequence
  Cyclicized modulating agent comprising desmocollin cell adhesion recognition sequence
FYVERD

SEQ ID NO: 900 - protein, 7 aa, Artificial Sequence
  Cyclicized modulating agent comprising desmocollin cell adhesion recognition sequence
FYVERDT

SEQ ID NO: 901 - protein, 8 aa, Artificial Sequence
  Cyclicized modulating agent comprising desmocollin cell adhesion recognition sequence
FYVERDTG

SEQ ID NO: 902 - protein, 7 aa, Artificial Sequence
  Cyclicized modulating agent comprising desmocollin cell adhesion recognition sequence
LFYVERD

SEQ ID NO: 903 - protein, 8 aa, Artificial Sequence
  Cyclicized modulating agent comprising desmocollin cell adhesion recognition sequence
LFYVERDT

SEQ ID NO: 904 - protein, 9 aa, Artificial Sequence
  Cyclicized modulating agent comprising desmocollin cell adhesion recognition sequence
LFYVERDTG

SEQ ID NO: 905 - protein, 5 aa, Artificial Sequence
  Cyclicized modulating agent comprising desmocollin cell adhesion recognition sequence
IERDT

SEQ ID NO: 906 - protein, 6 aa, Artificial Sequence
  Cyclicized modulating agent comprising desmocollin cell adhesion recognition sequence
IERDTG

SEQ ID NO: 907 - protein, 5 aa, Artificial Sequence
  Cyclicized modulating agent comprising desmocollin cell adhesion recognition sequence
YIERD

SEQ ID NO: 908 - protein, 6 aa, Artificial Sequence
  Cyclicized modulating agent comprising desmocollin cell adhesion recognition sequence
YIERDT

SEQ ID NO: 909 - protein, 7 aa, Artificial Sequence
  Cyclicized modulating agent comprising desmocollin cell adhesion recognition sequence
YIERDTG

SEQ ID NO: 910 - protein, 6 aa, Artificial Sequence
  Cyclicized modulating agent comprising desmocollin cell adhesion recognition sequence
FYIERD

SEQ ID NO: 911 - protein, 7 aa, Artificial Sequence
  Cyclicized modulating agent comprising desmocollin cell adhesion recognition sequence
FYIERDT

SEQ ID NO: 912 - protein, 8 aa, Artificial Sequence
  Cyclicized modulating agent comprising desmocollin cell adhesion recognition sequence
FYIERDTG

SEQ ID NO: 913 - protein, 7 aa, Artificial Sequence
  Cyclicized modulating agent comprising desmocollin cell adhesion recognition sequence
LFYIERD

SEQ ID NO: 914 - protein, 8 aa, Artificial Sequence
  Cyclicized modulating agent comprising desmocollin cell adhesion recognition sequence
LFYIERDT

SEQ ID NO: 915 - protein, 9 aa, Artificial Sequence
  Cyclicized modulating agent comprising desmocollin cell adhesion recognition sequence
LFYIERDTG

SEQ ID NO: 916 - protein, 5 aa, Artificial Sequence
  Cyclicized modulating agent comprising desmoglein-1 cell adhesion recognition sequence
CRALC

SEQ ID NO: 917 - protein, 6 aa, Artificial Sequence
  Cyclicized modulating agent comprising desmoglein-1 cell adhesion recognition sequence
CRALNC

SEQ ID NO: 918 - protein, 7 aa, Artificial Sequence
  Cyclicized modulating agent comprising desmoglein-1 cell adhesion recognition sequence
CRALNSC

SEQ ID NO: 919 - protein, 8 aa, Artificial Sequence
  Cyclicized modulating agent comprising desmoglein-1 cell adhesion recognition sequence
CRALNSMC

SEQ ID NO: 920 - protein, 8 aa, Artificial Sequence
  Cyclicized modulating agent comprising desmoglein-1 cell adhesion recognition sequence
CRALNSLC

SEQ ID NO: 921 - protein, 9 aa, Artificial Sequence
  Cyclicized modulating agent comprising desmoglein-1 cell adhesion recognition sequence
CRALNSMGC

SEQ ID NO: 922 - protein, 9 aa, Artificial Sequence
  Cyclicized modulating agent comprising desmoglein-1 cell adhesion recognition sequence
CRALNSLGC

SEQ ID NO: 923 - protein, 6 aa, Artificial Sequence
  Cyclicized modulating agent comprising desmoglein-1 cell adhesion recognition sequence
CCRALC

SEQ ID NO: 924 - protein, 7 aa, Artificial Sequence
  Cyclicized modulating agent comprising desmoglein-1 cell adhesion recognition sequence
CCRALNC

SEQ ID NO: 925 - protein, 8 aa, Artificial Sequence
  Cyclicized modulating agent comprising desmoglein-1 cell adhesion recognition sequence
CCRALNSC

SEQ ID NO: 926 - protein, 9 aa, Artificial Sequence
  Cyclicized modulating agent comprising desmoglein-1 cell adhesion recognition sequence
CCRALNSMC

SEQ ID NO: 927 - protein, 9 aa, Artificial Sequence
  Cyclicized modulating agent comprising desmoglein-1 cell adhesion recognition sequence
CCRALNSLC

SEQ ID NO: 928 - protein, 10 aa, Artificial Sequence
  Cyclicized modulating agent comprising desmoglein-1 cell adhesion recognition sequence
CCRALNSMGC

SEQ ID NO: 929 - protein, 10 aa, Artificial Sequence
  Cyclicized modulating agent comprising desmoglein-1 cell adhesion recognition sequence
CCRALNSLGC

SEQ ID NO: 930 - protein, 7 aa, Artificial Sequence
  Cyclicized modulating agent comprising desmoglein-1 cell adhesion recognition sequence
CYCRALC

SEQ ID NO: 931 - protein, 8 aa, Artificial Sequence
  Cyclicized modulating agent comprising desmoglein-1 cell adhesion recognition sequence
CYCRALNC

SEQ ID NO: 932 - protein, 9 aa, Artificial Sequence
  Cyclicized modulating agent comprising desmoglein-1 cell adhesion recognition sequence
CYCRALNSC

SEQ ID NO: 933 - protein, 10 aa, Artificial Sequence
  Cyclicized modulating agent comprising desmoglein-1 cell adhesion recognition sequence
CYCRALNSMC

SEQ ID NO: 934 - protein, 10 aa, Artificial Sequence
  Cyclicized modulating agent comprising desmoglein-1 cell adhesion recognition sequence
CYCRALNSLC

SEQ ID NO: 935 - protein, 11 aa, Artificial Sequence
  Cyclicized modulating agent comprising desmoglein-1 cell adhesion recognition sequence
CYCRALNSMGC

SEQ ID NO: 936 - protein, 11 aa, Artificial Sequence
  Cyclicized modulating agent comprising desmoglein-1 cell adhesion recognition sequence
CYCRALNSLGC

SEQ ID NO: 937 - protein, 7 aa, Artificial Sequence
  Cyclicized modulating agent comprising desmoglein-1 cell adhesion recognition sequence
CIYRALC

SEQ ID NO: 938 - protein, 8 aa, Artificial Sequence
  Cyclicized modulating agent comprising desmoglein-1 cell adhesion recognition sequence
CIYRALNC

SEQ ID NO: 939 - protein, 9 aa, Artificial Sequence
  Cyclicized modulating agent comprising desmoglein-1 cell adhesion recognition sequence
CIYRALNSC

SEQ ID NO: 940 - protein, 10 aa, Artificial Sequence
  Cyclicized modulating agent comprising desmoglein-1 cell adhesion recognition sequence
CIYRALNSMC

SEQ ID NO: 941 - protein, 10 aa, Artificial Sequence
  Cyclicized modulating agent comprising desmoglein-1 cell adhesion recognition sequence
CIYRALNSLC

SEQ ID NO: 942 - protein, 11 aa, Artificial Sequence
  Cyclicized modulating agent comprising desmoglein-1 cell adhesion recognition sequence
CIYRALNSMGC

SEQ ID NO: 943 - protein, 11 aa, Artificial Sequence
  Cyclicized modulating agent comprising desmoglein-1 cell adhesion recognition sequence
CIYRALNSLGC

SEQ ID NO: 944 - protein, 5 aa, Artificial Sequence
  Cyclicized modulating agent comprising desmoglein-1 cell adhesion recognition sequence
ERALK

SEQ ID NO: 945 - protein, 6 aa, Artificial Sequence
  Cyclicized modulating agent comprising desmoglein-1 cell adhesion recognition sequence
ERALNK

SEQ ID NO: 946 - protein, 7 aa, Artificial Sequence
  Cyclicized modulating agent comprising desmoglein-1 cell adhesion recognition sequence
ERALNSK

SEQ ID NO: 947 - protein, 8 aa, Artificial Sequence
  Cyclicized modulating agent comprising desmoglein-1 cell adhesion recognition sequence
ERALNSMK

SEQ ID NO: 948 - protein, 8 aa, Artificial Sequence
  Cyclicized modulating agent comprising desmoglein-1 cell adhesion recognition sequence
ERALNSLK

SEQ ID NO: 949 - protein, 9 aa, Artificial Sequence
  Cyclicized modulating agent comprising desmoglein-1 cell adhesion recognition sequence
ERALNSMGK

SEQ ID NO: 950 - protein, 9 aa, Artificial Sequence
  Cyclicized modulating agent comprising desmoglein-1 cell adhesion recognition sequence
ERALNSLGK

SEQ ID NO: 951 - protein, 6 aa, Artificial Sequence
  Cyclicized modulating agent comprising desmoglein-1 cell adhesion recognition sequence
ECRALK

SEQ ID NO: 952 - protein, 7 aa, Artificial Sequence
  Cyclicized modulating agent comprising desmoglein-1 cell adhesion recognition sequence
ECRALNK

SEQ ID NO: 953 - protein, 8 aa, Artificial Sequence
  Cyclicized modulating agent comprising desmoglein-1 cell adhesion recognition sequence
ECRALNSK

SEQ ID NO: 954 - protein, 9 aa, Artificial Sequence
  Cyclicized modulating agent comprising desmoglein-1 cell adhesion recognition sequence
ECRALNSMK

SEQ ID NO: 955 - protein, 9 aa, Artificial Sequence
  Cyclicized modulating agent comprising desmoglein-1 cell adhesion recognition sequence
ECRALNSLK

SEQ ID NO: 956 - protein, 10 aa, Artificial Sequence
  Cyclicized modulating agent comprising desmoglein-1 cell adhesion recognition sequence
ECRALNSMGK

SEQ ID NO: 957 - protein, 10 aa, Artificial Sequence
  Cyclicized modulating agent comprising desmoglein-1 cell adhesion recognition sequence
ECRALNSLGK

SEQ ID NO: 958 - protein, 7 aa, Artificial Sequence
  Cyclicized modulating agent comprising desmoglein-1 cell adhesion recognition sequence
EYCRALK

SEQ ID NO: 959 - protein, 8 aa, Artificial Sequence
  Cyclicized modulating agent comprising desmoglein-1 cell adhesion recognition sequence
EYCRALNK

SEQ ID NO: 960 - protein, 9 aa, Artificial Sequence
  Cyclicized modulating agent comprising desmoglein-1 cell adhesion recognition sequence
EYCRALNSK

SEQ ID NO: 961 - protein, 10 aa, Artificial Sequence
  Cyclicized modulating agent comprising desmoglein-1 cell adhesion recognition sequence
EYCRALNSMK

SEQ ID NO: 962 - protein, 10 aa, Artificial Sequence
  Cyclicized modulating agent comprising desmoglein-1 cell adhesion recognition sequence
EYCRALNSLK

SEQ ID NO: 963 - protein, 11 aa, Artificial Sequence
  Cyclicized modulating agent comprising desmoglein-1 cell adhesion recognition sequence
EYCRALNSMGK

SEQ ID NO: 964 - protein, 11 aa, Artificial Sequence
  Cyclicized modulating agent comprising desmoglein-1 cell adhesion recognition sequence
EYCRALNSLGK

SEQ ID NO: 965 - protein, 7 aa, Artificial Sequence
  Cyclicized modulating agent comprising desmoglein-1 cell adhesion recognition sequence
EIYRALK

SEQ ID NO: 966 - protein, 8 aa, Artificial Sequence
  Cyclicized modulating agent comprising desmoglein-1 cell adhesion recognition sequence
EIYRALNK

SEQ ID NO: 967 - protein, 9 aa, Artificial Sequence
  Cyclicized modulating agent comprising desmoglein-1 cell adhesion recognition sequence
EIYRALNSK

SEQ ID NO: 968 - protein, 10 aa, Artificial Sequence
  Cyclicized modulating agent comprising desmoglein-1 cell adhesion recognition sequence
EIYRALNSMK

SEQ ID NO: 969 - protein, 10 aa, Artificial Sequence
  Cyclicized modulating agent comprising desmoglein-1 cell adhesion recognition sequence
EIYRALNSLK

SEQ ID NO: 970 - protein, 11 aa, Artificial Sequence
  Cyclicized modulating agent comprising desmoglein-1 cell adhesion recognition sequence
EIYRALNSMGK

SEQ ID NO: 971 - protein, 11 aa, Artificial Sequence
  Cyclicized modulating agent comprising desmoglein-1 cell adhesion recognition sequence
EIYRALNSLGK

SEQ ID NO: 972 - protein, 5 aa, Artificial Sequence
  Cyclicized modulating agent comprising desmoglein-1 cell adhesion recognition sequence
KRALE

SEQ ID NO: 973 - protein, 6 aa, Artificial Sequence
  Cyclicized modulating agent comprising desmoglein-1 cell adhesion recognition sequence
KRALNE

SEQ ID NO: 974 - protein, 7 aa, Artificial Sequence
  Cyclicized modulating agent comprising desmoglein-1 cell adhesion recognition sequence
KRALNSE

SEQ ID NO: 975 - protein, 8 aa, Artificial Sequence
  Cyclicized modulating agent comprising desmoglein-1 cell adhesion recognition sequence
KRALNSME

SEQ ID NO: 976 - protein, 8 aa, Artificial Sequence
  Cyclicized modulating agent comprising desmoglein-1 cell adhesion recognition sequence
KRALNSLE

SEQ ID NO: 977 - protein, 9 aa, Artificial Sequence
  Cyclicized modulating agent comprising desmoglein-1 cell adhesion recognition sequence
KRALNSMGE

SEQ ID NO: 978 - protein, 9 aa, Artificial Sequence
  Cyclicized modulating agent comprising desmoglein-1 cell adhesion recognition sequence
KRALNSLGE

SEQ ID NO: 979 - protein, 6 aa, Artificial Sequence
  Cyclicized modulating agent comprising desmoglein-1 cell adhesion recognition sequence
KCRALE

SEQ ID NO: 980 - protein, 7 aa, Artificial Sequence
  Cyclicized modulating agent comprising desmoglein-1 cell adhesion recognition sequence
KCRALNE

SEQ ID NO: 981 - protein, 8 aa, Artificial Sequence
  Cyclicized modulating agent comprising desmoglein-1 cell adhesion recognition sequence
KCRALNSE

SEQ ID NO: 982 - protein, 9 aa, Artificial Sequence
  Cyclicized modulating agent comprising desmoglein-1 cell adhesion recognition sequence
KCRALNSME

SEQ ID NO: 983 - protein, 9 aa, Artificial Sequence
  Cyclicized modulating agent comprising desmoglein-1 cell adhesion recognition sequence
KCRALNSLE

SEQ ID NO: 984 - protein, 10 aa, Artificial Sequence
  Cyclicized modulating agent comprising desmoglein-1 cell adhesion recognition sequence
KCRALNSMGE

SEQ ID NO: 985 - protein, 10 aa, Artificial Sequence
  Cyclicized modulating agent comprising desmoglein-1 cell adhesion recognition sequence
KCRALNSLGE

SEQ ID NO: 986 - protein, 7 aa, Artificial Sequence
  Cyclicized modulating agent comprising desmoglein-1 cell adhesion recognition sequence
KYCRALE

SEQ ID NO: 987 - protein, 8 aa, Artificial Sequence
  Cyclicized modulating agent comprising desmoglein-1 cell adhesion recognition sequence
KYCRALNE

SEQ ID NO: 988 - protein, 9 aa, Artificial Sequence
  Cyclicized modulating agent comprising desmoglein-1 cell adhesion recognition sequence
KYCRALNSE

SEQ ID NO: 989 - protein, 10 aa, Artificial Sequence
  Cyclicized modulating agent comprising desmoglein-1 cell adhesion recognition sequence
KYCRALNSME

SEQ ID NO: 990 - protein, 10 aa, Artificial Sequence
  Cyclicized modulating agent comprising desmoglein-1 cell adhesion recognition sequence
KYCRALNSLE

SEQ ID NO: 991 - protein, 11 aa, Artificial Sequence
  Cyclicized modulating agent comprising desmoglein-1 cell adhesion recognition sequence
KYCRALNSMGE

SEQ ID NO: 992 - protein, 11 aa, Artificial Sequence
  Cyclicized modulating agent comprising desmoglein-1 cell adhesion recognition sequence
KYCRALNSLGE

SEQ ID NO: 993 - protein, 7 aa, Artificial Sequence
  Cyclicized modulating agent comprising desmoglein-1 cell adhesion recognition sequence
KIYRALE

SEQ ID NO: 994 - protein, 8 aa, Artificial Sequence
  Cyclicized modulating agent comprising desmoglein-1 cell adhesion recognition sequence
KIYRALNE

SEQ ID NO: 995 - protein, 9 aa, Artificial Sequence
  Cyclicized modulating agent comprising desmoglein-1 cell adhesion recognition sequence
KIYRALNSE

SEQ ID NO: 996 - protein, 10 aa, Artificial Sequence
  Cyclicized modulating agent comprising desmoglein-1 cell adhesion recognition sequence
KIYRALNSME

SEQ ID NO: 997 - protein, 10 aa, Artificial Sequence
  Cyclicized modulating agent comprising desmoglein-1 cell adhesion recognition sequence
KIYRALNSLE

SEQ ID NO: 998 - protein, 11 aa, Artificial Sequence
  Cyclicized modulating agent comprising desmoglein-1 cell adhesion recognition sequence
KIYRALNSMGE

SEQ ID NO: 999 - protein, 11 aa, Artificial Sequence
  Cyclicized modulating agent comprising desmoglein-1 cell adhesion recognition sequence
KIYRALNSLGE

SEQ ID NO: 1000 - protein, 5 aa, Artificial Sequence
  Cyclicized modulating agent comprising desmoglein-1 cell adhesion recognition sequence
DRALK

SEQ ID NO: 1001 - protein, 6 aa, Artificial Sequence
  Cyclicized modulating agent comprising desmoglein-1 cell adhesion recognition sequence
DRALNK

SEQ ID NO: 1002 - protein, 7 aa, Artificial Sequence
  Cyclicized modulating agent comprising desmoglein-1 cell adhesion recognition sequence
DRALNSK

SEQ ID NO: 1003 - protein, 8 aa, Artificial Sequence
  Cyclicized modulating agent comprising desmoglein-1 cell adhesion recognition sequence
DRALNSMK

SEQ ID NO: 1004 - protein, 8 aa, Artificial Sequence
  Cyclicized modulating agent comprising desmoglein-1 cell adhesion recognition sequence
DRALNSLK

SEQ ID NO: 1005 - protein, 9 aa, Artificial Sequence
  Cyclicized modulating agent comprising desmoglein-1 cell adhesion recognition sequence
DRALNSMGK

SEQ ID NO: 1006 - protein, 9 aa, Artificial Sequence
  Cyclicized modulating agent comprising desmoglein-1 cell adhesion recognition sequence
DRALNSLGK

SEQ ID NO: 1007 - protein, 6 aa, Artificial Sequence
  Cyclicized modulating agent comprising desmoglein-1 cell adhesion recognition sequence
DCRALK

SEQ ID NO: 1008 - protein, 7 aa, Artificial Sequence
  Cyclicized modulating agent comprising desmoglein-1 cell adhesion recognition sequence
DCRALNK

SEQ ID NO: 1009 - protein, 8 aa, Artificial Sequence
  Cyclicized modulating agent comprising desmoglein-1 cell adhesion recognition sequence
DCRALNSK

SEQ ID NO: 1010 - protein, 9 aa, Artificial Sequence
  Cyclicized modulating agent comprising desmoglein-1 cell adhesion recognition sequence
DCRALNSMK

SEQ ID NO: 1011 - protein, 9 aa, Artificial Sequence
  Cyclicized modulating agent comprising desmoglein-1 cell adhesion recognition sequence
DCRALNSLK

SEQ ID NO: 1012 - protein, 10 aa, Artificial Sequence
  Cyclicized modulating agent comprising desmoglein-1 cell adhesion recognition sequence
DCRALNSMGK

SEQ ID NO: 1013 - protein, 10 aa, Artificial Sequence
  Cyclicized modulating agent comprising desmoglein-1 cell adhesion recognition sequence
DCRALNSLGK

SEQ ID NO: 1014 - protein, 7 aa, Artificial Sequence
  Cyclicized modulating agent comprising desmoglein-1 cell adhesion recognition sequence
DYCRALK

SEQ ID NO: 1015 - protein, 8 aa, Artificial Sequence
  Cyclicized modulating agent comprising desmoglein-1 cell adhesion recognition sequence
DYCRALNK

SEQ ID NO: 1016 - protein, 9 aa, Artificial Sequence
  Cyclicized modulating agent comprising desmoglein-1 cell adhesion recognition sequence
DYCRALNSK

SEQ ID NO: 1017 - protein, 10 aa, Artificial Sequence
  Cyclicized modulating agent comprising desmoglein-1 cell adhesion recognition sequence
DYCRALNSMK

SEQ ID NO: 1018 - protein, 10 aa, Artificial Sequence
  Cyclicized modulating agent comprising desmoglein-1 cell adhesion recognition sequence
DYCRALNSLK

SEQ ID NO: 1019 - protein, 11 aa, Artificial Sequence
  Cyclicized modulating agent comprising desmoglein-1 cell adhesion recognition sequence
DYCRALNSMGK

SEQ ID NO: 1020 - protein, 11 aa, Artificial Sequence
  Cyclicized modulating agent comprising desmoglein-1 cell adhesion recognition sequence
DYCRALNSLGK

SEQ ID NO: 1021 - protein, 7 aa, Artificial Sequence
  Cyclicized modulating agent comprising desmoglein-1 cell adhesion recognition sequence
DIYRALK

SEQ ID NO: 1022 - protein, 8 aa, Artificial Sequence
  Cyclicized modulating agent comprising desmoglein-1 cell adhesion recognition sequence
DIYRALNK

SEQ ID NO: 1023 - protein, 9 aa, Artificial Sequence
  Cyclicized modulating agent comprising desmoglein-1 cell adhesion recognition sequence
DIYRALNSK

SEQ ID NO: 1024 - protein, 10 aa, Artificial Sequence
  Cyclicized modulating agent comprising desmoglein-1 cell adhesion recognition sequence
DIYRALNSMK

SEQ ID NO: 1025 - protein, 10 aa, Artificial Sequence
  Cyclicized modulating agent comprising desmoglein-1 cell adhesion recognition sequence
DIYRALNSLK

SEQ ID NO: 1026 - protein, 11 aa, Artificial Sequence
  Cyclicized modulating agent comprising desmoglein-1 cell adhesion recognition sequence
DIYRALNSMGK

SEQ ID NO: 1027 - protein, 11 aa, Artificial Sequence
  Cyclicized modulating agent comprising desmoglein-1 cell adhesion recognition sequence
DIYRALNSLGK

SEQ ID NO: 1028 - protein, 5 aa, Artificial Sequence
  Cyclicized modulating agent comprising desmoglein-1 cell adhesion recognition sequence
KRALD

SEQ ID NO: 1029 - protein, 6 aa, Artificial Sequence
  Cyclicized modulating agent comprising desmoglein-1 cell adhesion recognition sequence
KRALND

SEQ ID NO: 1030 - protein, 7 aa, Artificial Sequence
  Cyclicized modulating agent comprising desmoglein-1 cell adhesion recognition sequence
KRALNSD

SEQ ID NO: 1031 - protein, 8 aa, Artificial Sequence
  Cyclicized modulating agent comprising desmoglein-1 cell adhesion recognition sequence
KRALNSMD

SEQ ID NO: 1032 - protein, 8 aa, Artificial Sequence
  Cyclicized modulating agent comprising desmoglein-1 cell adhesion recognition sequence
KRALNSLD

SEQ ID NO: 1033 - protein, 9 aa, Artificial Sequence
  Cyclicized modulating agent comprising desmoglein-1 cell adhesion recognition sequence
KRALNSMGD

SEQ ID NO: 1034 - protein, 9 aa, Artificial Sequence
  Cyclicized modulating agent comprising desmoglein-1 cell adhesion recognition sequence
KRALNSLGD

SEQ ID NO: 1035 - protein, 6 aa, Artificial Sequence
  Cyclicized modulating agent comprising desmoglein-1 cell adhesion recognition sequence
KCRALD

SEQ ID NO: 1036 - protein, 7 aa, Artificial Sequence
  Cyclicized modulating agent comprising desmoglein-1 cell adhesion recognition sequence
KCRALND

SEQ ID NO: 1037 - protein, 8 aa, Artificial Sequence
  Cyclicized modulating agent comprising desmoglein-1 cell adhesion recognition sequence
KCRALNSD

SEQ ID NO: 1038 - protein, 9 aa, Artificial Sequence
  Cyclicized modulating agent comprising desmoglein-1 cell adhesion recognition sequence
KCRALNSMD

SEQ ID NO: 1039 - protein, 9 aa, Artificial Sequence
  Cyclicized modulating agent comprising desmoglein-1 cell adhesion recognition sequence
KCRALNSLD

SEQ ID NO: 1040 - protein, 10 aa, Artificial Sequence
  Cyclicized modulating agent comprising desmoglein-1 cell adhesion recognition sequence
KCRALNSMGD

SEQ ID NO: 1041 - protein, 10 aa, Artificial Sequence
  Cyclicized modulating agent comprising desmoglein-1 cell adhesion recognition sequence
KCRALNSLGD

SEQ ID NO: 1042 - protein, 7 aa, Artificial Sequence
  Cyclicized modulating agent comprising desmoglein-1 cell adhesion recognition sequence
KYCRALD

SEQ ID NO: 1043 - protein, 8 aa, Artificial Sequence
  Cyclicized modulating agent comprising desmoglein-1 cell adhesion recognition sequence
KYCRALND

SEQ ID NO: 1044 - protein, 9 aa, Artificial Sequence
  Cyclicized modulating agent comprising desmoglein-1 cell adhesion recognition sequence
KYCRALNSD

SEQ ID NO: 1045 - protein, 10 aa, Artificial Sequence
  Cyclicized modulating agent comprising desmoglein-1 cell adhesion recognition sequence
KYCRALNSMD

SEQ ID NO: 1046 - protein, 10 aa, Artificial Sequence
  Cyclicized modulating agent comprising desmoglein-1 cell adhesion recognition sequence
KYCRALNSLD

SEQ ID NO: 1047 - protein, 11 aa, Artificial Sequence
  Cyclicized modulating agent comprising desmoglein-1 cell adhesion recognition sequence
KYCRALNSMGD

SEQ ID NO: 1048 - protein, 11 aa, Artificial Sequence
  Cyclicized modulating agent comprising desmoglein-1 cell adhesion recognition sequence
KYCRALNSLGD

SEQ ID NO: 1049 - protein, 7 aa, Artificial Sequence
  Cyclicized modulating agent comprising desmoglein-1 cell adhesion recognition sequence
KIYRALD

SEQ ID NO: 1050 - protein, 8 aa, Artificial Sequence
  Cyclicized modulating agent comprising desmoglein-1 cell adhesion recognition sequence
KIYRALND

SEQ ID NO: 1051 - protein, 9 aa, Artificial Sequence
  Cyclicized modulating agent comprising desmoglein-1 cell adhesion recognition sequence
KIYRALNSD

SEQ ID NO: 1052 - protein, 10 aa, Artificial Sequence
  Cyclicized modulating agent comprising desmoglein-1 cell adhesion recognition sequence
KIYRALNSMD

SEQ ID NO: 1053 - protein, 10 aa, Artificial Sequence
  Cyclicized modulating agent comprising desmoglein-1 cell adhesion recognition sequence
KIYRALNSLD

SEQ ID NO: 1054 - protein, 11 aa, Artificial Sequence
  Cyclicized modulating agent comprising desmoglein-1 cell adhesion recognition sequence
KIYRALNSMGD

SEQ ID NO: 1055 - protein, 11 aa, Artificial Sequence
  Cyclicized modulating agent comprising desmoglein-1 cell adhesion recognition sequence
KIYRALNSLGD

SEQ ID NO: 1056 - protein, 5 aa, Artificial Sequence
  Cyclicized modulating agent comprising desmoglein-1 cell adhesion recognition sequence
RALNS

SEQ ID NO: 1057 - protein, 6 aa, Artificial Sequence
  Cyclicized modulating agent comprising desmoglein-1 cell adhesion recognition sequence
RALNSM

SEQ ID NO: 1058 - protein, 6 aa, Artificial Sequence
  Cyclicized modulating agent comprising desmoglein-1 cell adhesion recognition sequence
RALNSL

SEQ ID NO: 1059 - protein, 7 aa, Artificial Sequence
  Cyclicized modulating agent comprising desmoglein-1 cell adhesion recognition sequence
RALNSMG

SEQ ID NO: 1060 - protein, 7 aa, Artificial Sequence
  Cyclicized modulating agent comprising desmoglein-1 cell adhesion recognition sequence
RALNSLG

SEQ ID NO: 1061 - protein, 5 aa, Artificial Sequence
  Cyclicized modulating agent comprising desmoglein-1 cell adhesion recognition sequence
CRALN

SEQ ID NO: 1062 - protein, 6 aa, Artificial Sequence
  Cyclicized modulating agent comprising desmoglein-1 cell adhesion recognition sequence
CRALNS

SEQ ID NO: 1063 - protein, 7 aa, Artificial Sequence
  Cyclicized modulating agent comprising desmoglein-1 cell adhesion recognition sequence
CRALNSM

SEQ ID NO: 1064 - protein, 7 aa, Artificial Sequence
  Cyclicized modulating agent comprising desmoglein-1 cell adhesion recognition sequence
CRALNSL

SEQ ID NO: 1065 - protein, 8 aa, Artificial Sequence
  Cyclicized modulating agent comprising desmoglein-1 cell adhesion recognition sequence
CRALNSMG

SEQ ID NO: 1066 - protein, 8 aa, Artificial Sequence
  Cyclicized modulating agent comprising desmoglein-1 cell adhesion recognition sequence
CRALNSLG

SEQ ID NO: 1067 - protein, 5 aa, Artificial Sequence
  Cyclicized modulating agent comprising desmoglein-1 cell adhesion recognition sequence
YCRAL

SEQ ID NO: 1068 - protein, 6 aa, Artificial Sequence
  Cyclicized modulating agent comprising desmoglein-1 cell adhesion recognition sequence
YCRALN

SEQ ID NO: 1069 - protein, 7 aa, Artificial Sequence
  Cyclicized modulating agent comprising desmoglein-1 cell adhesion recognition sequence
YCRALNS

SEQ ID NO: 1070 - protein, 8 aa, Artificial Sequence
  Cyclicized modulating agent comprising desmoglein-1 cell adhesion recognition sequence
YCRALNSM

SEQ ID NO: 1071 - protein, 8 aa, Artificial Sequence
  Cyclicized modulating agent comprising desmoglein-1 cell adhesion recognition sequence
YCRALNSL

SEQ ID NO: 1072 - protein, 9 aa, Artificial Sequence
  Cyclicized modulating agent comprising desmoglein-1 cell adhesion recognition sequence
YCRALNSMG

SEQ ID NO: 1073 - protein, 9 aa, Artificial Sequence
  Cyclicized modulating agent comprising desmoglein-1 cell adhesion recognition sequence
YCRALNSLG

SEQ ID NO: 1074 - protein, 5 aa, Artificial Sequence
  Cyclicized modulating agent comprising desmoglein-1 cell adhesion recognition sequence
IYRAL

SEQ ID NO: 1075 - protein, 6 aa, Artificial Sequence
  Cyclicized modulating agent comprising desmoglein-1 cell adhesion recognition sequence
IYRALN

SEQ ID NO: 1076 - protein, 7 aa, Artificial Sequence
  Cyclicized modulating agent comprising desmoglein-1 cell adhesion recognition sequence
IYRALNS

SEQ ID NO: 1077 - protein, 8 aa, Artificial Sequence
  Cyclicized modulating agent comprising desmoglein-1 cell adhesion recognition sequence
IYRALNSM

SEQ ID NO: 1078 - protein, 8 aa, Artificial Sequence
  Cyclicized modulating agent comprising desmoglein-1 cell adhesion recognition sequence
IYRALNSL

SEQ ID NO: 1079 - protein, 9 aa, Artificial Sequence
  Cyclicized modulating agent comprising desmoglein-1 cell adhesion recognition sequence
IYRALNSMG

SEQ ID NO: 1080 - protein, 9 aa, Artificial Sequence
  Cyclicized modulating agent comprising desmoglein-1 cell adhesion recognition sequence
IYRALNSLG

SEQ ID NO: 1081 - protein, 5 aa, Artificial Sequence
  Cyclicized modulating agent comprising desmoglein-2 cell adhesion recognition sequence
CYALC

SEQ ID NO: 1082 - protein, 6 aa, Artificial Sequence
  Cyclicized modulating agent comprising desmoglein-2 cell adhesion recognition sequence
CYALDC

SEQ ID NO: 1083 - protein, 7 aa, Artificial Sequence
  Cyclicized modulating agent comprising desmoglein-2 cell adhesion recognition sequence
CYALDAC

SEQ ID NO: 1084 - protein, 8 aa, Artificial Sequence
  Cyclicized modulating agent comprising desmoglein-2 cell adhesion recognition sequence
CYALDARC

SEQ ID NO: 1085 - protein, 9 aa, Artificial Sequence
  Cyclicized modulating agent comprising desmoglein-2 cell adhesion recognition sequence
CYALDARGC

SEQ ID NO: 1086 - protein, 6 aa, Artificial Sequence
  Cyclicized modulating agent comprising desmoglein-2 cell adhesion recognition sequence
CGYALC

SEQ ID NO: 1087 - protein, 7 aa, Artificial Sequence
  Cyclicized modulating agent comprising desmoglein-2 cell adhesion recognition sequence
CGYALDC

SEQ ID NO: 1088 - protein, 8 aa, Artificial Sequence
  Cyclicized modulating agent comprising desmoglein-2 cell adhesion recognition sequence
CGYALDAC

SEQ ID NO: 1089 - protein, 9 aa, Artificial Sequence
  Cyclicized modulating agent comprising desmoglein-2 cell adhesion recognition sequence
CGYALDARC

SEQ ID NO: 1090 - protein, 10 aa, Artificial Sequence
  Cyclicized modulating agent comprising desmoglein-2 cell adhesion recognition sequence
CGYALDARGC

SEQ ID NO: 1091 - protein, 7 aa, Artificial Sequence
  Cyclicized modulating agent comprising desmoglein-2 cell adhesion recognition sequence
CTGYALC

SEQ ID NO: 1092 - protein, 8 aa, Artificial Sequence
  Cyclicized modulating agent comprising desmoglein-2 cell adhesion recognition sequence
CTGYALDC

SEQ ID NO: 1093 - protein, 9 aa, Artificial Sequence
  Cyclicized modulating agent comprising desmoglein-2 cell adhesion recognition sequence
CTGYALDAC

SEQ ID NO: 1094 - protein, 10 aa, Artificial Sequence
  Cyclicized modulating agent comprising desmoglein-2 cell adhesion recognition sequence
CTGYALDARC

SEQ ID NO: 1095 - protein, 11 aa, Artificial Sequence
  Cyclicized modulating agent comprising desmoglein-2 cell adhesion recognition sequence
CTGYALDARGC

SEQ ID NO: 1096 - protein, 8 aa, Artificial Sequence
  Cyclicized modulating agent comprising desmoglein-2 cell adhesion recognition sequence
CLTGYALC

SEQ ID NO: 1097 - protein, 9 aa, Artificial Sequence
  Cyclicized modulating agent comprising desmoglein-2 cell adhesion recognition sequence
CLTGYALDC

SEQ ID NO: 1098 - protein, 10 aa, Artificial Sequence
  Cyclicized modulating agent comprising desmoglein-2 cell adhesion recognition sequence
CLTGYALDAC

SEQ ID NO: 1099 - protein, 11 aa, Artificial Sequence
  Cyclicized modulating agent comprising desmoglein-2 cell adhesion recognition sequence
CLTGYALDARC

SEQ ID NO: 1100 - protein, 12 aa, Artificial Sequence
  Cyclicized modulating agent comprising desmoglein-2 cell adhesion recognition sequence
CLTGYALDARGC

SEQ ID NO: 1101 - protein, 5 aa, Artificial Sequence
  Cyclicized modulating agent comprising desmoglein-2 cell adhesion recognition sequence
EYALK

SEQ ID NO: 1102 - protein, 6 aa, Artificial Sequence
  Cyclicized modulating agent comprising desmoglein-2 cell adhesion recognition sequence
EYALDK

SEQ ID NO: 1103 - protein, 7 aa, Artificial Sequence
  Cyclicized modulating agent comprising desmoglein-2 cell adhesion recognition sequence
EYALDAK

SEQ ID NO: 1104 - protein, 8 aa, Artificial Sequence
  Cyclicized modulating agent comprising desmoglein-2 cell adhesion recognition sequence
EYALDARK

SEQ ID NO: 1105 - protein, 9 aa, Artificial Sequence
  Cyclicized modulating agent comprising desmoglein-2 cell adhesion recognition sequence
EYALDARGK

SEQ ID NO: 1106 - protein, 6 aa, Artificial Sequence
  Cyclicized modulating agent comprising desmoglein-2 cell adhesion recognition sequence
EGYALK

SEQ ID NO: 1107 - protein, 7 aa, Artificial Sequence
  Cyclicized modulating agent comprising desmoglein-2 cell adhesion recognition sequence
EGYALDK

SEQ ID NO: 1108 - protein, 8 aa, Artificial Sequence
  Cyclicized modulating agent comprising desmoglein-2 cell adhesion recognition sequence
EGYALDAK

SEQ ID NO: 1109 - protein, 9 aa, Artificial Sequence
  Cyclicized modulating agent comprising desmoglein-2 cell adhesion recognition sequence
EGYALDARK

SEQ ID NO: 1110 - protein, 10 aa, Artificial Sequence
  Cyclicized modulating agent comprising desmoglein-2 cell adhesion recognition sequence
EGYALDARGK

SEQ ID NO: 1111 - protein, 7 aa, Artificial Sequence
  Cyclicized modulating agent comprising desmoglein-2 cell adhesion recognition sequence
ETGYALK

SEQ ID NO: 1112 - protein, 8 aa, Artificial Sequence
  Cyclicized modulating agent comprising desmoglein-2 cell adhesion recognition sequence
ETGYALDK

SEQ ID NO: 1113 - protein, 9 aa, Artificial Sequence
  Cyclicized modulating agent comprising desmoglein-2 cell adhesion recognition sequence
ETGYALDAK

SEQ ID NO: 1114 - protein, 10 aa, Artificial Sequence
  Cyclicized modulating agent comprising desmoglein-2 cell adhesion recognition sequence
ETGYALDARK

SEQ ID NO: 1115 - protein, 11 aa, Artificial Sequence
  Cyclicized modulating agent comprising desmoglein-2 cell adhesion recognition sequence
ETGYALDARGK

SEQ ID NO: 1116 - protein, 8 aa, Artificial Sequence
  Cyclicized modulating agent comprising desmoglein-2 cell adhesion recognition sequence
ELTGYALK

SEQ ID NO: 1117 - protein, 9 aa, Artificial Sequence
  Cyclicized modulating agent comprising desmoglein-2 cell adhesion recognition sequence
ELTGYALDK

SEQ ID NO: 1118 - protein, 10 aa, Artificial Sequence
  Cyclicized modulating agent comprising desmoglein-2 cell adhesion recognition sequence
ELTGYALDAK

SEQ ID NO: 1119 - protein, 11 aa, Artificial Sequence
  Cyclicized modulating agent comprising desmoglein-2 cell adhesion recognition sequence
ELTGYALDARK

SEQ ID NO: 1120 - protein, 12 aa, Artificial Sequence
  Cyclicized modulating agent comprising desmoglein-2 cell adhesion recognition sequence
ELTGYALDARGK

SEQ ID NO: 1121 - protein, 5 aa, Artificial Sequence
  Cyclicized modulating agent comprising desmoglein-2 cell adhesion recognition sequence
KYALE

SEQ ID NO: 1122 - protein, 6 aa, Artificial Sequence
  Cyclicized modulating agent comprising desmoglein-2 cell adhesion recognition sequence
KYALDE

SEQ ID NO: 1123 - protein, 7 aa, Artificial Sequence
  Cyclicized modulating agent comprising desmoglein-2 cell adhesion recognition sequence
KYALDAE

SEQ ID NO: 1124 - protein, 8 aa, Artificial Sequence
  Cyclicized modulating agent comprising desmoglein-2 cell adhesion recognition sequence
KYALDARE

SEQ ID NO: 1125 - protein, 9 aa, Artificial Sequence
  Cyclicized modulating agent comprising desmoglein-2 cell adhesion recognition sequence
KYALDARGE

SEQ ID NO: 1126 - protein, 6 aa, Artificial Sequence
  Cyclicized modulating agent comprising desmoglein-2 cell adhesion recognition sequence
KGYALE

SEQ ID NO: 1127 - protein, 7 aa, Artificial Sequence
  Cyclicized modulating agent comprising desmoglein-2 cell adhesion recognition sequence
KGYALDE

SEQ ID NO: 1128 - protein, 8 aa, Artificial Sequence
  Cyclicized modulating agent comprising desmoglein-2 cell adhesion recognition sequence
KGYALDAE

SEQ ID NO: 1129 - protein, 9 aa, Artificial Sequence
  Cyclicized modulating agent comprising desmoglein-2 cell adhesion recognition sequence
KGYALDARE

SEQ ID NO: 1130 - protein, 10 aa, Artificial Sequence
  Cyclicized modulating agent comprising desmoglein-2 cell adhesion recognition sequence
KGYALDARGE

SEQ ID NO: 1131 - protein, 7 aa, Artificial Sequence
  Cyclicized modulating agent comprising desmoglein-2 cell adhesion recognition sequence
KTGYALE

SEQ ID NO: 1132 - protein, 8 aa, Artificial Sequence
  Cyclicized modulating agent comprising desmoglein-2 cell adhesion recognition sequence
KTGYALDE

SEQ ID NO: 1133 - protein, 9 aa, Artificial Sequence
  Cyclicized modulating agent comprising desmoglein-2 cell adhesion recognition sequence
KTGYALDAE

SEQ ID NO: 1134 - protein, 10 aa, Artificial Sequence
  Cyclicized modulating agent comprising desmoglein-2 cell adhesion recognition sequence
KTGYALDARE

SEQ ID NO: 1135 - protein, 11 aa, Artificial Sequence
  Cyclicized modulating agent comprising desmoglein-2 cell adhesion recognition sequence
KTGYALDARGE

SEQ ID NO: 1136 - protein, 8 aa, Artificial Sequence
  Cyclicized modulating agent comprising desmoglein-2 cell adhesion recognition sequence
KLTGYALE

SEQ ID NO: 1137 - protein, 9 aa, Artificial Sequence
  Cyclicized modulating agent comprising desmoglein-2 cell adhesion recognition sequence
KLTGYALDE

SEQ ID NO: 1138 - protein, 10 aa, Artificial Sequence
  Cyclicized modulating agent comprising desmoglein-2 cell adhesion recognition sequence
KLTGYALDAE

SEQ ID NO: 1139 - protein, 11 aa, Artificial Sequence
  Cyclicized modulating agent comprising desmoglein-2 cell adhesion recognition sequence
KLTGYALDARE

SEQ ID NO: 1140 - protein, 12 aa, Artificial Sequence
  Cyclicized modulating agent comprising desmoglein-2 cell adhesion recognition sequence
KLTGYALDARGE

SEQ ID NO: 1141 - protein, 5 aa, Artificial Sequence
  Cyclicized modulating agent comprising desmoglein-2 cell adhesion recognition sequence
DYALK

SEQ ID NO: 1142 - protein, 6 aa, Artificial Sequence
  Cyclicized modulating agent comprising desmoglein-2 cell adhesion recognition sequence
DYALDK

SEQ ID NO: 1143 - protein, 7 aa, Artificial Sequence
  Cyclicized modulating agent comprising desmoglein-2 cell adhesion recognition sequence
DYALDAK

SEQ ID NO: 1144 - protein, 8 aa, Artificial Sequence
  Cyclicized modulating agent comprising desmoglein-2 cell adhesion recognition sequence
DYALDARK

SEQ ID NO: 1145 - protein, 9 aa, Artificial Sequence
  Cyclicized modulating agent comprising desmoglein-2 cell adhesion recognition sequence
DYALDARGK

SEQ ID NO: 1146 - protein, 6 aa, Artificial Sequence
  Cyclicized modulating agent comprising desmoglein-2 cell adhesion recognition sequence
DGYALK

SEQ ID NO: 1147 - protein, 7 aa, Artificial Sequence
  Cyclicized modulating agent comprising desmoglein-2 cell adhesion recognition sequence
DGYALDK

SEQ ID NO: 1148 - protein, 8 aa, Artificial Sequence
  Cyclicized modulating agent comprising desmoglein-2 cell adhesion recognition sequence
DGYALDAK

SEQ ID NO: 1149 - protein, 9 aa, Artificial Sequence
  Cyclicized modulating agent comprising desmoglein-2 cell adhesion recognition sequence
DGYALDARK

SEQ ID NO: 1150 - protein, 10 aa, Artificial Sequence
  Cyclicized modulating agent comprising desmoglein-2 cell adhesion recognition sequence
DGYALDARGK

SEQ ID NO: 1151 - protein, 7 aa, Artificial Sequence
  Cyclicized modulating agent comprising desmoglein-2 cell adhesion recognition sequence
DTGYALK

SEQ ID NO: 1152 - protein, 8 aa, Artificial Sequence
  Cyclicized modulating agent comprising desmoglein-2 cell adhesion recognition sequence
DTGYALDK

SEQ ID NO: 1153 - protein, 9 aa, Artificial Sequence
  Cyclicized modulating agent comprising desmoglein-2 cell adhesion recognition sequence
DTGYALDAK

SEQ ID NO: 1154 - protein, 10 aa, Artificial Sequence
  Cyclicized modulating agent comprising desmoglein-2 cell adhesion recognition sequence
DTGYALDARK

SEQ ID NO: 1155 - protein, 11 aa, Artificial Sequence
  Cyclicized modulating agent comprising desmoglein-2 cell adhesion recognition sequence
DTGYALDARGK

SEQ ID NO: 1156 - protein, 8 aa, Artificial Sequence
  Cyclicized modulating agent comprising desmoglein-2 cell adhesion recognition sequence
DLTGYALK

SEQ ID NO: 1157 - protein, 9 aa, Artificial Sequence
  Cyclicized modulating agent comprising desmoglein-2 cell adhesion recognition sequence
DLTGYALDK

SEQ ID NO: 1158 - protein, 10 aa, Artificial Sequence
  Cyclicized modulating agent comprising desmoglein-2 cell adhesion recognition sequence
DLTGYALDAK

SEQ ID NO: 1159 - protein, 11 aa, Artificial Sequence
  Cyclicized modulating agent comprising desmoglein-2 cell adhesion recognition sequence
DLTGYALDARK

SEQ ID NO: 1160 - protein, 12 aa, Artificial Sequence
  Cyclicized modulating agent comprising desmoglein-2 cell adhesion recognition sequence
DLTGYALDARGK

SEQ ID NO: 1161 - protein, 5 aa, Artificial Sequence
  Cyclicized modulating agent comprising desmoglein-2 cell adhesion recognition sequence
KYALD

SEQ ID NO: 1162 - protein, 6 aa, Artificial Sequence
  Cyclicized modulating agent comprising desmoglein-2 cell adhesion recognition sequence
KYALDD

SEQ ID NO: 1163 - protein, 7 aa, Artificial Sequence
  Cyclicized modulating agent comprising desmoglein-2 cell adhesion recognition sequence
KYALDAD

SEQ ID NO: 1164 - protein, 8 aa, Artificial Sequence
  Cyclicized modulating agent comprising desmoglein-2 cell adhesion recognition sequence
KYALDARD

SEQ ID NO: 1165 - protein, 9 aa, Artificial Sequence
  Cyclicized modulating agent comprising desmoglein-2 cell adhesion recognition sequence
KYALDARGD

SEQ ID NO: 1166 - protein, 6 aa, Artificial Sequence
  Cyclicized modulating agent comprising desmoglein-2 cell adhesion recognition sequence
KGYALD

SEQ ID NO: 1167 - protein, 7 aa, Artificial Sequence
  Cyclicized modulating agent comprising desmoglein-2 cell adhesion recognition sequence
KGYALDD

SEQ ID NO: 1168 - protein, 8 aa, Artificial Sequence
  Cyclicized modulating agent comprising desmoglein-2 cell adhesion recognition sequence
KGYALDAD

SEQ ID NO: 1169 - protein, 9 aa, Artificial Sequence
  Cyclicized modulating agent comprising desmoglein-2 cell adhesion recognition sequence
KGYALDARD

SEQ ID NO: 1170 - protein, 10 aa, Artificial Sequence
  Cyclicized modulating agent comprising desmoglein-2 cell adhesion recognition sequence
KGYALDARGD

SEQ ID NO: 1171 - protein, 7 aa, Artificial Sequence
  Cyclicized modulating agent comprising desmoglein-2 cell adhesion recognition sequence
KTGYALD

SEQ ID NO: 1172 - protein, 8 aa, Artificial Sequence
  Cyclicized modulating agent comprising desmoglein-2 cell adhesion recognition sequence
KTGYALDD

SEQ ID NO: 1173 - protein, 9 aa, Artificial Sequence
  Cyclicized modulating agent comprising desmoglein-2 cell adhesion recognition sequence
KTGYALDAD

SEQ ID NO: 1174 - protein, 10 aa, Artificial Sequence
  Cyclicized modulating agent comprising desmoglein-2 cell adhesion recognition sequence
KTGYALDARD

SEQ ID NO: 1175 - protein, 11 aa, Artificial Sequence
  Cyclicized modulating agent comprising desmoglein-2 cell adhesion recognition sequence
KTGYALDARGD

SEQ ID NO: 1176 - protein, 8 aa, Artificial Sequence
  Cyclicized modulating agent comprising desmoglein-2 cell adhesion recognition sequence
KLTGYALD

SEQ ID NO: 1177 - protein, 9 aa, Artificial Sequence
  Cyclicized modulating agent comprising desmoglein-2 cell adhesion recognition sequence
KLTGYALDD

SEQ ID NO: 1178 - protein, 10 aa, Artificial Sequence
  Cyclicized modulating agent comprising desmoglein-2 cell adhesion recognition sequence
KLTGYALDAD

SEQ ID NO: 1179 - protein, 11 aa, Artificial Sequence
  Cyclicized modulating agent comprising desmoglein-2 cell adhesion recognition sequence
KLTGYALDARD

SEQ ID NO: 1180 - protein, 12 aa, Artificial Sequence
  Cyclicized modulating agent comprising desmoglein-2 cell adhesion recognition sequence
KLTGYALDARGD

SEQ ID NO: 1181 - protein, 5 aa, Artificial Sequence
  Cyclicized modulating agent comprising desmoglein-2 cell adhesion recognition sequence
YALDA

SEQ ID NO: 1182 - protein, 6 aa, Artificial Sequence
  Cyclicized modulating agent comprising desmoglein-2 cell adhesion recognition sequence
YALDAR

SEQ ID NO: 1183 - protein, 7 aa, Artificial Sequence
  Cyclicized modulating agent comprising desmoglein-2 cell adhesion recognition sequence
YALDARG

SEQ ID NO: 1184 - protein, 5 aa, Artificial Sequence
  Cyclicized modulating agent comprising desmoglein-2 cell adhesion recognition sequence
GYALD

SEQ ID NO: 1185 - protein, 6 aa, Artificial Sequence
  Cyclicized modulating agent comprising desmoglein-2 cell adhesion recognition sequence
GYALDA

SEQ ID NO: 1186 - protein, 7 aa, Artificial Sequence
  Cyclicized modulating agent comprising desmoglein-2 cell adhesion recognition sequence
GYALDAR

SEQ ID NO: 1187 - protein, 8 aa, Artificial Sequence
  Cyclicized modulating agent comprising desmoglein-2 cell adhesion recognition sequence
GYALDARG

SEQ ID NO: 1188 - protein, 5 aa, Artificial Sequence
  Cyclicized modulating agent comprising desmoglein-2 cell adhesion recognition sequence
TGYAL

SEQ ID NO: 1189 - protein, 6 aa, Artificial Sequence
  Cyclicized modulating agent comprising desmoglein-2 cell adhesion recognition sequence
TGYALD

SEQ ID NO: 1190 - protein, 7 aa, Artificial Sequence
  Cyclicized modulating agent comprising desmoglein-2 cell adhesion recognition sequence
TGYALDA

SEQ ID NO: 1191 - protein, 8 aa, Artificial Sequence
  Cyclicized modulating agent comprising desmoglein-2 cell adhesion recognition sequence
TGYALDAR

SEQ ID NO: 1192 - protein, 9 aa, Artificial Sequence
  Cyclicized modulating agent comprising desmoglein-2 cell adhesion recognition sequence
TGYALDARG

SEQ ID NO: 1193 - protein, 6 aa, Artificial Sequence
  Cyclicized modulating agent comprising desmoglein-2 cell adhesion recognition sequence
LTGYAL

SEQ ID NO: 1194 - protein, 7 aa, Artificial Sequence
  Cyclicized modulating agent comprising desmoglein-2 cell adhesion recognition sequence
LTGYALD

SEQ ID NO: 1195 - protein, 8 aa, Artificial Sequence
  Cyclicized modulating agent comprising desmoglein-2 cell adhesion recognition sequence
LTGYALDA

SEQ ID NO: 1196 - protein, 9 aa, Artificial Sequence
  Cyclicized modulating agent comprising desmoglein-2 cell adhesion recognition sequence
LTGYALDAR

SEQ ID NO: 1197 - protein, 10 aa, Artificial Sequence
  Cyclicized modulating agent comprising desmoglein-2 cell adhesion recognition sequence
LTGYALDARG

SEQ ID NO: 1198 - protein, 7 aa, Artificial Sequence
  Cyclicized modulating agent comprising desmoglein-3 cell adhesion recognition sequence
CRALNAC

SEQ ID NO: 1199 - protein, 8 aa, Artificial Sequence
  Cyclicized modulating agent comprising desmoglein-3 cell adhesion recognition sequence
CRALNAQC

SEQ ID NO: 1200 - protein, 8 aa, Artificial Sequence
  Cyclicized modulating agent comprising desmoglein-3 cell adhesion recognition sequence
CRALNALC

SEQ ID NO: 1201 - protein, 9 aa, Artificial Sequence
  Cyclicized modulating agent comprising desmoglein-3 cell adhesion recognition sequence
CRALNAQGC

SEQ ID NO: 1202 - protein, 9 aa, Artificial Sequence
  Cyclicized modulating agent comprising desmoglein-3 cell adhesion recognition sequence
CRALNALGC

SEQ ID NO: 1203 - protein, 8 aa, Artificial Sequence
  Cyclicized modulating agent comprising desmoglein-3 cell adhesion recognition sequence
CCRALNAC

SEQ ID NO: 1204 - protein, 9 aa, Artificial Sequence
  Cyclicized modulating agent comprising desmoglein-3 cell adhesion recognition sequence
CCRALNAQC

SEQ ID NO: 1205 - protein, 9 aa, Artificial Sequence
  Cyclicized modulating agent comprising desmoglein-3 cell adhesion recognition sequence
CCRALNALC

SEQ ID NO: 1206 - protein, 10 aa, Artificial Sequence
  Cyclicized modulating agent comprising desmoglein-3 cell adhesion recognition sequence
CCRALNAQGC

SEQ ID NO: 1207 - protein, 10 aa, Artificial Sequence
  Cyclicized modulating agent comprising desmoglein-3 cell adhesion recognition sequence
CCRALNALGC

SEQ ID NO: 1208 - protein, 7 aa, Artificial Sequence
  Cyclicized modulating agent comprising desmoglein-3 cell adhesion recognition sequence
CTCRALC

SEQ ID NO: 1209 - protein, 8 aa, Artificial Sequence
  Cyclicized modulating agent comprising desmoglein-3 cell adhesion recognition sequence
CTCRALNC

SEQ ID NO: 1210 - protein, 9 aa, Artificial Sequence
  Cyclicized modulating agent comprising desmoglein-3 cell adhesion recognition sequence
CTCRALNAC

SEQ ID NO: 1211 - protein, 10 aa, Artificial Sequence
  Cyclicized modulating agent comprising desmoglein-3 cell adhesion recognition sequence
CTCRALNAQC

SEQ ID NO: 1212 - protein, 10 aa, Artificial Sequence
  Cyclicized modulating agent comprising desmoglein-3 cell adhesion recognition sequence
CTCRALNALC

SEQ ID NO: 1213 - protein, 11 aa, Artificial Sequence
  Cyclicized modulating agent comprising desmoglein-3 cell adhesion recognition sequence
CTCRALNAQGC

SEQ ID NO: 1214 - protein, 11 aa, Artificial Sequence
  Cyclicized modulating agent comprising desmoglein-3 cell adhesion recognition sequence
CTCRALNALGC

SEQ ID NO: 1215 - protein, 8 aa, Artificial Sequence
  Cyclicized modulating agent comprising desmoglein-3 cell adhesion recognition sequence
CITCRALC

SEQ ID NO: 1216 - protein, 9 aa, Artificial Sequence
  Cyclicized modulating agent comprising desmoglein-3 cell adhesion recognition sequence
CITCRALNC

SEQ ID NO: 1217 - protein, 10 aa, Artificial Sequence
  Cyclicized modulating agent comprising desmoglein-3 cell adhesion recognition sequence
CITCRALNAC

SEQ ID NO: 1218 - protein, 11 aa, Artificial Sequence
  Cyclicized modulating agent comprising desmoglein-3 cell adhesion recognition sequence
CITCRALNAQC

SEQ ID NO: 1219 - protein, 11 aa, Artificial Sequence
  Cyclicized modulating agent comprising desmoglein-3 cell adhesion recognition sequence
CITCRALNALC

SEQ ID NO: 1220 - protein, 12 aa, Artificial Sequence
  Cyclicized modulating agent comprising desmoglein-3 cell adhesion recognition sequence
CITCRALNAQGC

SEQ ID NO: 1221 - protein, 12 aa, Artificial Sequence
  Cyclicized modulating agent comprising desmoglein-3 cell adhesion recognition sequence
CITCRALNALGC

SEQ ID NO: 1222 - protein, 7 aa, Artificial Sequence
  Cyclicized modulating agent comprising desmoglein-3 cell adhesion recognition sequence
ERALNAK

SEQ ID NO: 1223 - protein, 8 aa, Artificial Sequence
  Cyclicized modulating agent comprising desmoglein-3 cell adhesion recognition sequence
ERALNAQK

SEQ ID NO: 1224 - protein, 8 aa, Artificial Sequence
  Cyclicized modulating agent comprising desmoglein-3 cell adhesion recognition sequence
ERALNALK

SEQ ID NO: 1225 - protein, 9 aa, Artificial Sequence
  Cyclicized modulating agent comprising desmoglein-3 cell adhesion recognition sequence
ERALNAQGK

SEQ ID NO: 1226 - protein, 9 aa, Artificial Sequence
  Cyclicized modulating agent comprising desmoglein-3 cell adhesion recognition sequence
ERALNALGK

SEQ ID NO: 1227 - protein, 8 aa, Artificial Sequence
  Cyclicized modulating agent comprising desmoglein-3 cell adhesion recognition sequence
ECRALNAK

SEQ ID NO: 1228 - protein, 9 aa, Artificial Sequence
  Cyclicized modulating agent comprising desmoglein-3 cell adhesion recognition sequence
ECRALNAQK

SEQ ID NO: 1229 - protein, 9 aa, Artificial Sequence
  Cyclicized modulating agent comprising desmoglein-3 cell adhesion recognition sequence
ECRALNALK

SEQ ID NO: 1230 - protein, 10 aa, Artificial Sequence
  Cyclicized modulating agent comprising desmoglein-3 cell adhesion recognition sequence
ECRALNAQGK

SEQ ID NO: 1231 - protein, 10 aa, Artificial Sequence
  Cyclicized modulating agent comprising desmoglein-3 cell adhesion recognition sequence
ECRALNALGK

SEQ ID NO: 1232 - protein, 7 aa, Artificial Sequence
  Cyclicized modulating agent comprising desmoglein-3 cell adhesion recognition sequence
ETCRALK

SEQ ID NO: 1233 - protein, 8 aa, Artificial Sequence
  Cyclicized modulating agent comprising desmoglein-3 cell adhesion recognition sequence
ETCRALNK

SEQ ID NO: 1234 - protein, 9 aa, Artificial Sequence
  Cyclicized modulating agent comprising desmoglein-3 cell adhesion recognition sequence
ETCRALNAK

SEQ ID NO: 1235 - protein, 10 aa, Artificial Sequence
  Cyclicized modulating agent comprising desmoglein-3 cell adhesion recognition sequence
ETCRALNAQK

SEQ ID NO: 1236 - protein, 10 aa, Artificial Sequence
  Cyclicized modulating agent comprising desmoglein-3 cell adhesion recognition sequence
ETCRALNALK

SEQ ID NO: 1237 - protein, 11 aa, Artificial Sequence
  Cyclicized modulating agent comprising desmoglein-3 cell adhesion recognition sequence
ETCRALNAQGK

SEQ ID NO: 1238 - protein, 11 aa, Artificial Sequence
  Cyclicized modulating agent comprising desmoglein-3 cell adhesion recognition sequence
ETCRALNALGK

SEQ ID NO: 1239 - protein, 8 aa, Artificial Sequence
  Cyclicized modulating agent comprising desmoglein-3 cell adhesion recognition sequence
EITCRALK

SEQ ID NO: 1240 - protein, 9 aa, Artificial Sequence
  Cyclicized modulating agent comprising desmoglein-3 cell adhesion recognition sequence
EITCRALNK

SEQ ID NO: 1241 - protein, 10 aa, Artificial Sequence
  Cyclicized modulating agent comprising desmoglein-3 cell adhesion recognition sequence
EITCRALNAK

SEQ ID NO: 1242 - protein, 11 aa, Artificial Sequence
  Cyclicized modulating agent comprising desmoglein-3 cell adhesion recognition sequence
EITCRALNAQK

SEQ ID NO: 1243 - protein, 11 aa, Artificial Sequence
  Cyclicized modulating agent comprising desmoglein-3 cell adhesion recognition sequence
EITCRALNALK

SEQ ID NO: 1244 - protein, 12 aa, Artificial Sequence
  Cyclicized modulating agent comprising desmoglein-3 cell adhesion recognition sequence
EITCRALNAQGK

SEQ ID NO: 1245 - protein, 12 aa, Artificial Sequence
  Cyclicized modulating agent comprising desmoglein-3 cell adhesion recognition sequence
EITCRALNALGK

SEQ ID NO: 1246 - protein, 7 aa, Artificial Sequence
  Cyclicized modulating agent comprising desmoglein-3 cell adhesion recognition sequence
KRALNAE

SEQ ID NO: 1247 - protein, 8 aa, Artificial Sequence
  Cyclicized modulating agent comprising desmoglein-3 cell adhesion recognition sequence
KRALNAQE

SEQ ID NO: 1248 - protein, 8 aa, Artificial Sequence
  Cyclicized modulating agent comprising desmoglein-3 cell adhesion recognition sequence
KRALNALE

SEQ ID NO: 1249 - protein, 9 aa, Artificial Sequence
  Cyclicized modulating agent comprising desmoglein-3 cell adhesion recognition sequence
KRALNAQGE

SEQ ID NO: 1250 - protein, 9 aa, Artificial Sequence
  Cyclicized modulating agent comprising desmoglein-3 cell adhesion recognition sequence
KRALNALGE

SEQ ID NO: 1251 - protein, 8 aa, Artificial Sequence
  Cyclicized modulating agent comprising desmoglein-3 cell adhesion recognition sequence
KCRALNAE

SEQ ID NO: 1252 - protein, 9 aa, Artificial Sequence
  Cyclicized modulating agent comprising desmoglein-3 cell adhesion recognition sequence
KCRALNAQE

SEQ ID NO: 1253 - protein, 9 aa, Artificial Sequence
  Cyclicized modulating agent comprising desmoglein-3 cell adhesion recognition sequence
KCRALNALE

SEQ ID NO: 1254 - protein, 10 aa, Artificial Sequence
  Cyclicized modulating agent comprising desmoglein-3 cell adhesion recognition sequence
KCRALNAQGE

SEQ ID NO: 1255 - protein, 10 aa, Artificial Sequence
  Cyclicized modulating agent comprising desmoglein-3 cell adhesion recognition sequence
KCRALNALGE

SEQ ID NO: 1256 - protein, 7 aa, Artificial Sequence
  Cyclicized modulating agent comprising desmoglein-3 cell adhesion recognition sequence
KTCRALE

SEQ ID NO: 1257 - protein, 8 aa, Artificial Sequence
  Cyclicized modulating agent comprising desmoglein-3 cell adhesion recognition sequence
KTCRALNE

SEQ ID NO: 1258 - protein, 9 aa, Artificial Sequence
  Cyclicized modulating agent comprising desmoglein-3 cell adhesion recognition sequence
KTCRALNAE

SEQ ID NO: 1259 - protein, 10 aa, Artificial Sequence
  Cyclicized modulating agent comprising desmoglein-3 cell adhesion recognition sequence
KTCRALNAQE

SEQ ID NO: 1260 - protein, 10 aa, Artificial Sequence
  Cyclicized modulating agent comprising desmoglein-3 cell adhesion recognition sequence
KTCRALNALE

SEQ ID NO: 1261 - protein, 11 aa, Artificial Sequence
  Cyclicized modulating agent comprising desmoglein-3 cell adhesion recognition sequence
KTCRALNAQGE

SEQ ID NO: 1262 - protein, 11 aa, Artificial Sequence
  Cyclicized modulating agent comprising desmoglein-3 cell adhesion recognition sequence
KTCRALNALGE

SEQ ID NO: 1263 - protein, 8 aa, Artificial Sequence
  Cyclicized modulating agent comprising desmoglein-3 cell adhesion recognition sequence
KITCRALE

SEQ ID NO: 1264 - protein, 9 aa, Artificial Sequence
  Cyclicized modulating agent comprising desmoglein-3 cell adhesion recognition sequence
KITCRALNE

SEQ ID NO: 1265 - protein, 10 aa, Artificial Sequence
  Cyclicized modulating agent comprising desmoglein-3 cell adhesion recognition sequence
KITCRALNAE

SEQ ID NO: 1266 - protein, 11 aa, Artificial Sequence
  Cyclicized modulating agent comprising desmoglein-3 cell adhesion recognition sequence
KITCRALNAQE

SEQ ID NO: 1267 - protein, 11 aa, Artificial Sequence
  Cyclicized modulating agent comprising desmoglein-3 cell adhesion recognition sequence
KITCRALNALE

SEQ ID NO: 1268 - protein, 12 aa, Artificial Sequence
  Cyclicized modulating agent comprising desmoglein-3 cell adhesion recognition sequence
KITCRALNAQGE

SEQ ID NO: 1269 - protein, 12 aa, Artificial Sequence
  Cyclicized modulating agent comprising desmoglein-3 cell adhesion recognition sequence
KITCRALNALGE

SEQ ID NO: 1270 - protein, 7 aa, Artificial Sequence
  Cyclicized modulating agent comprising desmoglein-3 cell adhesion recognition sequence
DRALNAK

SEQ ID NO: 1271 - protein, 8 aa, Artificial Sequence
  Cyclicized modulating agent comprising desmoglein-3 cell adhesion recognition sequence
DRALNAQK

SEQ ID NO: 1272 - protein, 8 aa, Artificial Sequence
  Cyclicized modulating agent comprising desmoglein-3 cell adhesion recognition sequence
DRALNALK

SEQ ID NO: 1273 - protein, 9 aa, Artificial Sequence
  Cyclicized modulating agent comprising desmoglein-3 cell adhesion recognition sequence
DRALNAQGK

SEQ ID NO: 1274 - protein, 9 aa, Artificial Sequence
  Cyclicized modulating agent comprising desmoglein-3 cell adhesion recognition sequence
DRALNALGK

SEQ ID NO: 1275 - protein, 8 aa, Artificial Sequence
  Cyclicized modulating agent comprising desmoglein-3 cell adhesion recognition sequence
DCRALNAK

SEQ ID NO: 1276 - protein, 9 aa, Artificial Sequence
  Cyclicized modulating agent comprising desmoglein-3 cell adhesion recognition sequence
DCRALNAQK

SEQ ID NO: 1277 - protein, 9 aa, Artificial Sequence
  Cyclicized modulating agent comprising desmoglein-3 cell adhesion recognition sequence
DCRALNALK

SEQ ID NO: 1278 - protein, 10 aa, Artificial Sequence
  Cyclicized modulating agent comprising desmoglein-3 cell adhesion recognition sequence
DCRALNAQGK

SEQ ID NO: 1279 - protein, 10 aa, Artificial Sequence
  Cyclicized modulating agent comprising desmoglein-3 cell adhesion recognition sequence
DCRALNALGK

SEQ ID NO: 1280 - protein, 7 aa, Artificial Sequence
  Cyclicized modulating agent comprising desmoglein-3 cell adhesion recognition sequence
DTCRALK

SEQ ID NO: 1281 - protein, 8 aa, Artificial Sequence
  Cyclicized modulating agent comprising desmoglein-3 cell adhesion recognition sequence
DTCRALNK

SEQ ID NO: 1282 - protein, 9 aa, Artificial Sequence
  Cyclicized modulating agent comprising desmoglein-3 cell adhesion recognition sequence
DTCRALNAK

SEQ ID NO: 1283 - protein, 10 aa, Artificial Sequence
  Cyclicized modulating agent comprising desmoglein-3 cell adhesion recognition sequence
DTCRALNAQK

SEQ ID NO: 1284 - protein, 10 aa, Artificial Sequence
  Cyclicized modulating agent comprising desmoglein-3 cell adhesion recognition sequence
DTCRALNALK

SEQ ID NO: 1285 - protein, 11 aa, Artificial Sequence
  Cyclicized modulating agent comprising desmoglein-3 cell adhesion recognition sequence
DTCRALNAQGK

SEQ ID NO: 1286 - protein, 11 aa, Artificial Sequence
  Cyclicized modulating agent comprising desmoglein-3 cell adhesion recognition sequence
DTCRALNALGK

SEQ ID NO: 1287 - protein, 8 aa, Artificial Sequence
  Cyclicized modulating agent comprising desmoglein-3 cell adhesion recognition sequence
DITCRALK

SEQ ID NO: 1288 - protein, 9 aa, Artificial Sequence
  Cyclicized modulating agent comprising desmoglein-3 cell adhesion recognition sequence
DITCRALNK

SEQ ID NO: 1289 - protein, 10 aa, Artificial Sequence
  Cyclicized modulating agent comprising desmoglein-3 cell adhesion recognition sequence
DITCRALNAK

SEQ ID NO: 1290 - protein, 11 aa, Artificial Sequence
  Cyclicized modulating agent comprising desmoglein-3 cell adhesion recognition sequence
DITCRALNAQK

SEQ ID NO: 1291 - protein, 11 aa, Artificial Sequence
  Cyclicized modulating agent comprising desmoglein-3 cell adhesion recognition sequence
DITCRALNALK

SEQ ID NO: 1292 - protein, 12 aa, Artificial Sequence
  Cyclicized modulating agent comprising desmoglein-3 cell adhesion recognition sequence
DITCRALNAQGK

SEQ ID NO: 1293 - protein, 12 aa, Artificial Sequence
  Cyclicized modulating agent comprising desmoglein-3 cell adhesion recognition sequence
DITCRALNALGK

SEQ ID NO: 1294 - protein, 7 aa, Artificial Sequence
  Cyclicized modulating agent comprising desmoglein-3 cell adhesion recognition sequence
KRALNAD

SEQ ID NO: 1295 - protein, 8 aa, Artificial Sequence
  Cyclicized modulating agent comprising desmoglein-3 cell adhesion recognition sequence
KRALNAQD

SEQ ID NO: 1296 - protein, 8 aa, Artificial Sequence
  Cyclicized modulating agent comprising desmoglein-3 cell adhesion recognition sequence
KRALNALD

SEQ ID NO: 1297 - protein, 9 aa, Artificial Sequence
  Cyclicized modulating agent comprising desmoglein-3 cell adhesion recognition sequence
KRALNAQGD

SEQ ID NO: 1298 - protein, 9 aa, Artificial Sequence
  Cyclicized modulating agent comprising desmoglein-3 cell adhesion recognition sequence
KRALNALGD

SEQ ID NO: 1299 - protein, 8 aa, Artificial Sequence
  Cyclicized modulating agent comprising desmoglein-3 cell adhesion recognition sequence
KCRALNAD

SEQ ID NO: 1300 - protein, 9 aa, Artificial Sequence
  Cyclicized modulating agent comprising desmoglein-3 cell adhesion recognition sequence
KCRALNAQD

SEQ ID NO: 1301 - protein, 9 aa, Artificial Sequence
  Cyclicized modulating agent comprising desmoglein-3 cell adhesion recognition sequence
KCRALNALD

SEQ ID NO: 1302 - protein, 10 aa, Artificial Sequence
  Cyclicized modulating agent comprising desmoglein-3 cell adhesion recognition sequence
KCRALNAQGD

SEQ ID NO: 1303 - protein, 10 aa, Artificial Sequence
  Cyclicized modulating agent comprising desmoglein-3 cell adhesion recognition sequence
KCRALNALGD

SEQ ID NO: 1304 - protein, 7 aa, Artificial Sequence
  Cyclicized modulating agent comprising desmoglein-3 cell adhesion recognition sequence
KTCRALD

SEQ ID NO: 1305 - protein, 8 aa, Artificial Sequence
  Cyclicized modulating agent comprising desmoglein-3 cell adhesion recognition sequence
KTCRALND

SEQ ID NO: 1306 - protein, 9 aa, Artificial Sequence
  Cyclicized modulating agent comprising desmoglein-3 cell adhesion recognition sequence
KTCRALNAD

SEQ ID NO: 1307 - protein, 10 aa, Artificial Sequence
  Cyclicized modulating agent comprising desmoglein-3 cell adhesion recognition sequence
KTCRALNAQD

SEQ ID NO: 1308 - protein, 10 aa, Artificial Sequence
  Cyclicized modulating agent comprising desmoglein-3 cell adhesion recognition sequence
KTCRALNALD

SEQ ID NO: 1309 - protein, 11 aa, Artificial Sequence
  Cyclicized modulating agent comprising desmoglein-3 cell adhesion recognition sequence
KTCRALNAQGD

SEQ ID NO: 1310 - protein, 11 aa, Artificial Sequence
  Cyclicized modulating agent comprising desmoglein-3 cell adhesion recognition sequence
KTCRALNALGD

SEQ ID NO: 1311 - protein, 8 aa, Artificial Sequence
  Cyclicized modulating agent comprising desmoglein-3 cell adhesion recognition sequence
KITCRALD

SEQ ID NO: 1312 - protein, 9 aa, Artificial Sequence
  Cyclicized modulating agent comprising desmoglein-3 cell adhesion recognition sequence
KITCRALND

SEQ ID NO: 1313 - protein, 10 aa, Artificial Sequence
  Cyclicized modulating agent comprising desmoglein-3 cell adhesion recognition sequence
KITCRALNAD

SEQ ID NO: 1314 - protein, 11 aa, Artificial Sequence
  Cyclicized modulating agent comprising desmoglein-3 cell adhesion recognition sequence
KITCRALNAQD

SEQ ID NO: 1315 - protein, 11 aa, Artificial Sequence
  Cyclicized modulating agent comprising desmoglein-3 cell adhesion recognition sequence
KITCRALNALD

SEQ ID NO: 1316 - protein, 12 aa, Artificial Sequence
  Cyclicized modulating agent comprising desmoglein-3 cell adhesion recognition sequence
KITCRALNAQGD

SEQ ID NO: 1317 - protein, 12 aa, Artificial Sequence
  Cyclicized modulating agent comprising desmoglein-3 cell adhesion recognition sequence
KITCRALNALGD

SEQ ID NO: 1318 - protein, 5 aa, Artificial Sequence
  Cyclicized modulating agent comprising desmoglein-3 cell adhesion recognition sequence
RALNA

SEQ ID NO: 1319 - protein, 6 aa, Artificial Sequence
  Cyclicized modulating agent comprising desmoglein-3 cell adhesion recognition sequence
RALNAQ

SEQ ID NO: 1320 - protein, 6 aa, Artificial Sequence
  Cyclicized modulating agent comprising desmoglein-3 cell adhesion recognition sequence
RALNAL

SEQ ID NO: 1321 - protein, 7 aa, Artificial Sequence
  Cyclicized modulating agent comprising desmoglein-3 cell adhesion recognition sequence
RALNAQG

SEQ ID NO: 1322 - protein, 7 aa, Artificial Sequence
  Cyclicized modulating agent comprising desmoglein-3 cell adhesion recognition sequence
RALNALG

SEQ ID NO: 1323 - protein, 5 aa, Artificial Sequence
  Cyclicized modulating agent comprising desmoglein-3 cell adhesion recognition sequence
CRALN

SEQ ID NO: 1324 - protein, 6 aa, Artificial Sequence
  Cyclicized modulating agent comprising desmoglein-3 cell adhesion recognition sequence
CRALNA

SEQ ID NO: 1325 - protein, 7 aa, Artificial Sequence
  Cyclicized modulating agent comprising desmoglein-3 cell adhesion recognition sequence
CRALNAQ

SEQ ID NO: 1326 - protein, 7 aa, Artificial Sequence
  Cyclicized modulating agent comprising desmoglein-3 cell adhesion recognition sequence
CRALNAL

SEQ ID NO: 1327 - protein, 8 aa, Artificial Sequence
  Cyclicized modulating agent comprising desmoglein-3 cell adhesion recognition sequence
CRALNAQG

SEQ ID NO: 1328 - protein, 8 aa, Artificial Sequence
  Cyclicized modulating agent comprising desmoglein-3 cell adhesion recognition sequence
CRALNALG

SEQ ID NO: 1329 - protein, 5 aa, Artificial Sequence
  Cyclicized modulating agent comprising desmoglein-3 cell adhesion recognition sequence
TCRAL

SEQ ID NO: 1330 - protein, 6 aa, Artificial Sequence
  Cyclicized modulating agent comprising desmoglein-3 cell adhesion recognition sequence
TCRALN

SEQ ID NO: 1331 - protein, 7 aa, Artificial Sequence
  Cyclicized modulating agent comprising desmoglein-3 cell adhesion recognition sequence
TCRALNA

SEQ ID NO: 1332 - protein, 8 aa, Artificial Sequence
  Cyclicized modulating agent comprising desmoglein-3 cell adhesion recognition sequence
TCRALNAQ

SEQ ID NO: 1333 - protein, 8 aa, Artificial Sequence
  Cyclicized modulating agent comprising desmoglein-3 cell adhesion recognition sequence
TCRALNAL

SEQ ID NO: 1334 - protein, 9 aa, Artificial Sequence
  Cyclicized modulating agent comprising desmoglein-3 cell adhesion recognition sequence
TCRALNAQG

SEQ ID NO: 1335 - protein, 9 aa, Artificial Sequence
  Cyclicized modulating agent comprising desmoglein-3 cell adhesion recognition sequence
TCRALNALG

SEQ ID NO: 1336 - protein, 6 aa, Artificial Sequence
  Cyclicized modulating agent comprising desmoglein-3 cell adhesion recognition sequence
ITCRAL

SEQ ID NO: 1337 - protein, 7 aa, Artificial Sequence
  Cyclicized modulating agent comprising desmoglein-3 cell adhesion recognition sequence
ITCRALN

SEQ ID NO: 1338 - protein, 8 aa, Artificial Sequence
  Cyclicized modulating agent comprising desmoglein-3 cell adhesion recognition sequence
ITCRALNA

SEQ ID NO: 1339 - protein, 9 aa, Artificial Sequence
  Cyclicized modulating agent comprising desmoglein-3 cell adhesion recognition sequence
ITCRALNAQ

SEQ ID NO: 1340 - protein, 9 aa, Artificial Sequence
  Cyclicized modulating agent comprising desmoglein-3 cell adhesion recognition sequence
ITCRALNAL

SEQ ID NO: 1341 - protein, 10 aa, Artificial Sequence
  Cyclicized modulating agent comprising desmoglein-3 cell adhesion recognition sequence
ITCRALNAQG

SEQ ID NO: 1342 - protein, 10 aa, Artificial Sequence
  Cyclicized modulating agent comprising desmoglein-3 cell adhesion recognition sequence
ITCRALNALG

SEQ ID NO: 1343 - protein, 5 aa, Artificial Sequence
  Cyclicized modulating agent comprising desmocollin-1 cell adhesion recognition sequence
CYATC

SEQ ID NO: 1344 - protein, 6 aa, Artificial Sequence
  Cyclicized modulating agent comprising desmocollin-1 cell adhesion recognition sequence
CYATTC

SEQ ID NO: 1345 - protein, 7 aa, Artificial Sequence
  Cyclicized modulating agent comprising desmocollin-1 cell adhesion recognition sequence
CYATTAC

SEQ ID NO: 1346 - protein, 8 aa, Artificial Sequence
  Cyclicized modulating agent comprising desmocollin-1 cell adhesion recognition sequence
CYATTADC

SEQ ID NO: 1347 - protein, 9 aa, Artificial Sequence
  Cyclicized modulating agent comprising desmocollin-1 cell adhesion recognition sequence
CYATTADGC

SEQ ID NO: 1348 - protein, 6 aa, Artificial Sequence
  Cyclicized modulating agent comprising desmocollin-1 cell adhesion recognition sequence
CGYATC

SEQ ID NO: 1349 - protein, 7 aa, Artificial Sequence
  Cyclicized modulating agent comprising desmocollin-1 cell adhesion recognition sequence
CGYATTC

SEQ ID NO: 1350 - protein, 8 aa, Artificial Sequence
  Cyclicized modulating agent comprising desmocollin-1 cell adhesion recognition sequence
CGYATTAC

SEQ ID NO: 1351 - protein, 9 aa, Artificial Sequence
  Cyclicized modulating agent comprising desmocollin-1 cell adhesion recognition sequence
CGYATTADC

SEQ ID NO: 1352 - protein, 10 aa, Artificial Sequence
  Cyclicized modulating agent comprising desmocollin-1 cell adhesion recognition sequence
CGYATTADGC

SEQ ID NO: 1353 - protein, 6 aa, Artificial Sequence
  Cyclicized modulating agent comprising desmocollin-1 cell adhesion recognition sequence
CAYATC

SEQ ID NO: 1354 - protein, 7 aa, Artificial Sequence
  Cyclicized modulating agent comprising desmocollin-1 cell adhesion recognition sequence
CAYATTC

SEQ ID NO: 1355 - protein, 8 aa, Artificial Sequence
  Cyclicized modulating agent comprising desmocollin-1 cell adhesion recognition sequence
CAYATTAC

SEQ ID NO: 1356 - protein, 9 aa, Artificial Sequence
  Cyclicized modulating agent comprising desmocollin-1 cell adhesion recognition sequence
CAYATTADC

SEQ ID NO: 1357 - protein, 10 aa, Artificial Sequence
  Cyclicized modulating agent comprising desmocollin-1 cell adhesion recognition sequence
CAYATTADGC

SEQ ID NO: 1358 - protein, 7 aa, Artificial Sequence
  Cyclicized modulating agent comprising desmocollin-1 cell adhesion recognition sequence
CYGYATC

SEQ ID NO: 1359 - protein, 8 aa, Artificial Sequence
  Cyclicized modulating agent comprising desmocollin-1 cell adhesion recognition sequence
CYGYATTC

SEQ ID NO: 1360 - protein, 9 aa, Artificial Sequence
  Cyclicized modulating agent comprising desmocollin-1 cell adhesion recognition sequence
CYGYATTAC

SEQ ID NO: 1361 - protein, 10 aa, Artificial Sequence
  Cyclicized modulating agent comprising desmocollin-1 cell adhesion recognition sequence
CYGYATTADC

SEQ ID NO: 1362 - protein, 11 aa, Artificial Sequence
  Cyclicized modulating agent comprising desmocollin-1 cell adhesion recognition sequence
CYGYATTADGC

SEQ ID NO: 1363 - protein, 7 aa, Artificial Sequence
  Cyclicized modulating agent comprising desmocollin-1 cell adhesion recognition sequence
CYAYATC

SEQ ID NO: 1364 - protein, 8 aa, Artificial Sequence
  Cyclicized modulating agent comprising desmocollin-1 cell adhesion recognition sequence
CYAYATTC

SEQ ID NO: 1365 - protein, 9 aa, Artificial Sequence
  Cyclicized modulating agent comprising desmocollin-1 cell adhesion recognition sequence
CYAYATTAC

SEQ ID NO: 1366 - protein, 10 aa, Artificial Sequence
  Cyclicized modulating agent comprising desmocollin-1 cell adhesion recognition sequence
CYAYATTADC

SEQ ID NO: 1367 - protein, 11 aa, Artificial Sequence
  Cyclicized modulating agent comprising desmocollin-1 cell adhesion recognition sequence
CYAYATTADGC

SEQ ID NO: 1368 - protein, 8 aa, Artificial Sequence
  Cyclicized modulating agent comprising desmocollin-1 cell adhesion recognition sequence
CLYGYATC

SEQ ID NO: 1369 - protein, 9 aa, Artificial Sequence
  Cyclicized modulating agent comprising desmocollin-1 cell adhesion recognition sequence
CLYGYATTC

SEQ ID NO: 1370 - protein, 10 aa, Artificial Sequence
  Cyclicized modulating agent comprising desmocollin-1 cell adhesion recognition sequence
CLYGYATTAC

SEQ ID NO: 1371 - protein, 11 aa, Artificial Sequence
  Cyclicized modulating agent comprising desmocollin-1 cell adhesion recognition sequence
CLYGYATTADC

SEQ ID NO: 1372 - protein, 12 aa, Artificial Sequence
  Cyclicized modulating agent comprising desmocollin-1 cell adhesion recognition sequence
CLYGYATTADGC

SEQ ID NO: 1373 - protein, 8 aa, Artificial Sequence
  Cyclicized modulating agent comprising desmocollin-1 cell adhesion recognition sequence
CLYAYATC

SEQ ID NO: 1374 - protein, 9 aa, Artificial Sequence
  Cyclicized modulating agent comprising desmocollin-1 cell adhesion recognition sequence
CLYAYATTC

SEQ ID NO: 1375 - protein, 10 aa, Artificial Sequence
  Cyclicized modulating agent comprising desmocollin-1 cell adhesion recognition sequence
CLYAYATTAC

SEQ ID NO: 1376 - protein, 11 aa, Artificial Sequence
  Cyclicized modulating agent comprising desmocollin-1 cell adhesion recognition sequence
CLYAYATTADC

SEQ ID NO: 1377 - protein, 12 aa, Artificial Sequence
  Cyclicized modulating agent comprising desmocollin-1 cell adhesion recognition sequence
CLYAYATTADGC

SEQ ID NO: 1378 - protein, 8 aa, Artificial Sequence
  Cyclicized modulating agent comprising desmocollin-1 cell adhesion recognition sequence
CVYGYATC

SEQ ID NO: 1379 - protein, 9 aa, Artificial Sequence
  Cyclicized modulating agent comprising desmocollin-1 cell adhesion recognition sequence
CVYGYATTC

SEQ ID NO: 1380 - protein, 10 aa, Artificial Sequence
  Cyclicized modulating agent comprising desmocollin-1 cell adhesion recognition sequence
CVYGYATTAC

SEQ ID NO: 1381 - protein, 11 aa, Artificial Sequence
  Cyclicized modulating agent comprising desmocollin-1 cell adhesion recognition sequence
CVYGYATTADC

SEQ ID NO: 1382 - protein, 12 aa, Artificial Sequence
  Cyclicized modulating agent comprising desmocollin-1 cell adhesion recognition sequence
CVYGYATTADGC

SEQ ID NO: 1383 - protein, 8 aa, Artificial Sequence
  Cyclicized modulating agent comprising desmocollin-1 cell adhesion recognition sequence
CVYAYATC

SEQ ID NO: 1384 - protein, 9 aa, Artificial Sequence
  Cyclicized modulating agent comprising desmocollin-1 cell adhesion recognition sequence
CVYAYATTC

SEQ ID NO: 1385 - protein, 10 aa, Artificial Sequence
  Cyclicized modulating agent comprising desmocollin-1 cell adhesion recognition sequence
CVYAYATTAC

SEQ ID NO: 1386 - protein, 11 aa, Artificial Sequence
  Cyclicized modulating agent comprising desmocollin-1 cell adhesion recognition sequence
CVYAYATTADC

SEQ ID NO: 1387 - protein, 12 aa, Artificial Sequence
  Cyclicized modulating agent comprising desmocollin-1 cell adhesion recognition sequence
CVYAYATTADGC

SEQ ID NO: 1388 - protein, 8 aa, Artificial Sequence
  Cyclicized modulating agent comprising desmocollin-1 cell adhesion recognition sequence
CIYGYATC

SEQ ID NO: 1389 - protein, 9 aa, Artificial Sequence
  Cyclicized modulating agent comprising desmocollin-1 cell adhesion recognition sequence
CIYGYATTC

SEQ ID NO: 1390 - protein, 10 aa, Artificial Sequence
  Cyclicized modulating agent comprising desmocollin-1 cell adhesion recognition sequence
CIYGYATTAC

SEQ ID NO: 1391 - protein, 11 aa, Artificial Sequence
  Cyclicized modulating agent comprising desmocollin-1 cell adhesion recognition sequence
CIYGYATTADC

SEQ ID NO: 1392 - protein, 12 aa, Artificial Sequence
  Cyclicized modulating agent comprising desmocollin-1 cell adhesion recognition sequence
CIYGYATTADGC

SEQ ID NO: 1393 - protein, 8 aa, Artificial Sequence
  Cyclicized modulating agent comprising desmocollin-1 cell adhesion recognition sequence
CIYAYATC

SEQ ID NO: 1394 - protein, 9 aa, Artificial Sequence
  Cyclicized modulating agent comprising desmocollin-1 cell adhesion recognition sequence
CIYAYATTC

SEQ ID NO: 1395 - protein, 10 aa, Artificial Sequence
  Cyclicized modulating agent comprising desmocollin-1 cell adhesion recognition sequence
CIYAYATTAC

SEQ ID NO: 1396 - protein, 11 aa, Artificial Sequence
  Cyclicized modulating agent comprising desmocollin-1 cell adhesion recognition sequence
CIYAYATTADC

SEQ ID NO: 1397 - protein, 12 aa, Artificial Sequence
  Cyclicized modulating agent comprising desmocollin-1 cell adhesion recognition sequence
CIYAYATTADGC

SEQ ID NO: 1398 - protein, 5 aa, Artificial Sequence
  Cyclicized modulating agent comprising desmocollin-1 cell adhesion recognition sequence
EYATK

SEQ ID NO: 1399 - protein, 6 aa, Artificial Sequence
  Cyclicized modulating agent comprising desmocollin-1 cell adhesion recognition sequence
EYATTK

SEQ ID NO: 1400 - protein, 7 aa, Artificial Sequence
  Cyclicized modulating agent comprising desmocollin-1 cell adhesion recognition sequence
EYATTAK

SEQ ID NO: 1401 - protein, 8 aa, Artificial Sequence
  Cyclicized modulating agent comprising desmocollin-1 cell adhesion recognition sequence
EYATTADK

SEQ ID NO: 1402 - protein, 9 aa, Artificial Sequence
  Cyclicized modulating agent comprising desmocollin-1 cell adhesion recognition sequence
EYATTADGK

SEQ ID NO: 1403 - protein, 6 aa, Artificial Sequence
  Cyclicized modulating agent comprising desmocollin-1 cell adhesion recognition sequence
EGYATK

SEQ ID NO: 1404 - protein, 7 aa, Artificial Sequence
  Cyclicized modulating agent comprising desmocollin-1 cell adhesion recognition sequence
EGYATTK

SEQ ID NO: 1405 - protein, 8 aa, Artificial Sequence
  Cyclicized modulating agent comprising desmocollin-1 cell adhesion recognition sequence
EGYATTAK

SEQ ID NO: 1406 - protein, 9 aa, Artificial Sequence
  Cyclicized modulating agent comprising desmocollin-1 cell adhesion recognition sequence
EGYATTADK

SEQ ID NO: 1407 - protein, 10 aa, Artificial Sequence
  Cyclicized modulating agent comprising desmocollin-1 cell adhesion recognition sequence
EGYATTADGK

SEQ ID NO: 1408 - protein, 6 aa, Artificial Sequence
  Cyclicized modulating agent comprising desmocollin-1 cell adhesion recognition sequence
EAYATK

SEQ ID NO: 1409 - protein, 7 aa, Artificial Sequence
  Cyclicized modulating agent comprising desmocollin-1 cell adhesion recognition sequence
EAYATTK

SEQ ID NO: 1410 - protein, 8 aa, Artificial Sequence
  Cyclicized modulating agent comprising desmocollin-1 cell adhesion recognition sequence
EAYATTAK

SEQ ID NO: 1411 - protein, 9 aa, Artificial Sequence
  Cyclicized modulating agent comprising desmocollin-1 cell adhesion recognition sequence
EAYATTADK

SEQ ID NO: 1412 - protein, 10 aa, Artificial Sequence
  Cyclicized modulating agent comprising desmocollin-1 cell adhesion recognition sequence
EAYATTADGK

SEQ ID NO: 1413 - protein, 7 aa, Artificial Sequence
  Cyclicized modulating agent comprising desmocollin-1 cell adhesion recognition sequence
EYGYATK

SEQ ID NO: 1414 - protein, 8 aa, Artificial Sequence
  Cyclicized modulating agent comprising desmocollin-1 cell adhesion recognition sequence
EYGYATTK

SEQ ID NO: 1415 - protein, 9 aa, Artificial Sequence
  Cyclicized modulating agent comprising desmocollin-1 cell adhesion recognition sequence
EYGYATTAK

SEQ ID NO: 1416 - protein, 10 aa, Artificial Sequence
  Cyclicized modulating agent comprising desmocollin-1 cell adhesion recognition sequence
EYGYATTADK

SEQ ID NO: 1417 - protein, 11 aa, Artificial Sequence
  Cyclicized modulating agent comprising desmocollin-1 cell adhesion recognition sequence
EYGYATTADGK

SEQ ID NO: 1418 - protein, 7 aa, Artificial Sequence
  Cyclicized modulating agent comprising desmocollin-1 cell adhesion recognition sequence
EYAYATK

SEQ ID NO: 1419 - protein, 8 aa, Artificial Sequence
  Cyclicized modulating agent comprising desmocollin-1 cell adhesion recognition sequence
EYAYATTK

SEQ ID NO: 1420 - protein, 9 aa, Artificial Sequence
  Cyclicized modulating agent comprising desmocollin-1 cell adhesion recognition sequence
EYAYATTAK

SEQ ID NO: 1421 - protein, 10 aa, Artificial Sequence
  Cyclicized modulating agent comprising desmocollin-1 cell adhesion recognition sequence
EYAYATTADK

SEQ ID NO: 1422 - protein, 11 aa, Artificial Sequence
  Cyclicized modulating agent comprising desmocollin-1 cell adhesion recognition sequence
EYAYATTADGK

SEQ ID NO: 1423 - protein, 8 aa, Artificial Sequence
  Cyclicized modulating agent comprising desmocollin-1 cell adhesion recognition sequence
ELYGYATK

SEQ ID NO: 1424 - protein, 9 aa, Artificial Sequence
  Cyclicized modulating agent comprising desmocollin-1 cell adhesion recognition sequence
ELYGYATTK

SEQ ID NO: 1425 - protein, 10 aa, Artificial Sequence
  Cyclicized modulating agent comprising desmocollin-1 cell adhesion recognition sequence
ELYGYATTAK

SEQ ID NO: 1426 - protein, 11 aa, Artificial Sequence
  Cyclicized modulating agent comprising desmocollin-1 cell adhesion recognition sequence
ELYGYATTADK

SEQ ID NO: 1427 - protein, 12 aa, Artificial Sequence
  Cyclicized modulating agent comprising desmocollin-1 cell adhesion recognition sequence
ELYGYATTADGK

SEQ ID NO: 1428 - protein, 8 aa, Artificial Sequence
  Cyclicized modulating agent comprising desmocollin-1 cell adhesion recognition sequence
ELYAYATK

SEQ ID NO: 1429 - protein, 9 aa, Artificial Sequence
  Cyclicized modulating agent comprising desmocollin-1 cell adhesion recognition sequence
ELYAYATTK

SEQ ID NO: 1430 - protein, 10 aa, Artificial Sequence
  Cyclicized modulating agent comprising desmocollin-1 cell adhesion recognition sequence
ELYAYATTAK

SEQ ID NO: 1431 - protein, 11 aa, Artificial Sequence
  Cyclicized modulating agent comprising desmocollin-1 cell adhesion recognition sequence
ELYAYATTADK

SEQ ID NO: 1432 - protein, 12 aa, Artificial Sequence
  Cyclicized modulating agent comprising desmocollin-1 cell adhesion recognition sequence
ELYAYATTADGK

SEQ ID NO: 1433 - protein, 8 aa, Artificial Sequence
  Cyclicized modulating agent comprising desmocollin-1 cell adhesion recognition sequence
EVYGYATK

SEQ ID NO: 1434 - protein, 9 aa, Artificial Sequence
  Cyclicized modulating agent comprising desmocollin-1 cell adhesion recognition sequence
EVYGYATTK

SEQ ID NO: 1435 - protein, 10 aa, Artificial Sequence
  Cyclicized modulating agent comprising desmocollin-1 cell adhesion recognition sequence
EVYGYATTAK

SEQ ID NO: 1436 - protein, 11 aa, Artificial Sequence
  Cyclicized modulating agent comprising desmocollin-1 cell adhesion recognition sequence
EVYGYATTADK

SEQ ID NO: 1437 - protein, 12 aa, Artificial Sequence
  Cyclicized modulating agent comprising desmocollin-1 cell adhesion recognition sequence
EVYGYATTADGK

SEQ ID NO: 1438 - protein, 8 aa, Artificial Sequence
  Cyclicized modulating agent comprising desmocollin-1 cell adhesion recognition sequence
EVYAYATK

SEQ ID NO: 1439 - protein, 9 aa, Artificial Sequence
  Cyclicized modulating agent comprising desmocollin-1 cell adhesion recognition sequence
EVYAYATTK

SEQ ID NO: 1440 - protein, 10 aa, Artificial Sequence
  Cyclicized modulating agent comprising desmocollin-1 cell adhesion recognition sequence
EVYAYATTAK

SEQ ID NO: 1441 - protein, 11 aa, Artificial Sequence
  Cyclicized modulating agent comprising desmocollin-1 cell adhesion recognition sequence
EVYAYATTADK

SEQ ID NO: 1442 - protein, 12 aa, Artificial Sequence
  Cyclicized modulating agent comprising desmocollin-1 cell adhesion recognition sequence
EVYAYATTADGK

SEQ ID NO: 1443 - protein, 8 aa, Artificial Sequence
  Cyclicized modulating agent comprising desmocollin-1 cell adhesion recognition sequence
EIYGYATK

SEQ ID NO: 1444 - protein, 9 aa, Artificial Sequence
  Cyclicized modulating agent comprising desmocollin-1 cell adhesion recognition sequence
EIYGYATTK

SEQ ID NO: 1445 - protein, 10 aa, Artificial Sequence
  Cyclicized modulating agent comprising desmocollin-1 cell adhesion recognition sequence
EIYGYATTAK

SEQ ID NO: 1446 - protein, 11 aa, Artificial Sequence
  Cyclicized modulating agent comprising desmocollin-1 cell adhesion recognition sequence
EIYGYATTADK

SEQ ID NO: 1447 - protein, 12 aa, Artificial Sequence
  Cyclicized modulating agent comprising desmocollin-1 cell adhesion recognition sequence
EIYGYATTADGK

SEQ ID NO: 1448 - protein, 8 aa, Artificial Sequence
  Cyclicized modulating agent comprising desmocollin-1 cell adhesion recognition sequence
EIYAYATK

SEQ ID NO: 1449 - protein, 9 aa, Artificial Sequence
  Cyclicized modulating agent comprising desmocollin-1 cell adhesion recognition sequence
EIYAYATTK

SEQ ID NO: 1450 - protein, 10 aa, Artificial Sequence
  Cyclicized modulating agent comprising desmocollin-1 cell adhesion recognition sequence
EIYAYATTAK

SEQ ID NO: 1451 - protein, 11 aa, Artificial Sequence
  Cyclicized modulating agent comprising desmocollin-1 cell adhesion recognition sequence
EIYAYATTADK

SEQ ID NO: 1452 - protein, 12 aa, Artificial Sequence
  Cyclicized modulating agent comprising desmocollin-1 cell adhesion recognition sequence
EIYAYATTADGK

SEQ ID NO: 1453 - protein, 5 aa, Artificial Sequence
  Cyclicized modulating agent comprising desmocollin-1 cell adhesion recognition sequence
KYATE

SEQ ID NO: 1454 - protein, 6 aa, Artificial Sequence
  Cyclicized modulating agent comprising desmocollin-1 cell adhesion recognition sequence
KYATTE

SEQ ID NO: 1455 - protein, 7 aa, Artificial Sequence
  Cyclicized modulating agent comprising desmocollin-1 cell adhesion recognition sequence
KYATTAE

SEQ ID NO: 1456 - protein, 8 aa, Artificial Sequence
  Cyclicized modulating agent comprising desmocollin-1 cell adhesion recognition sequence
KYATTADE

SEQ ID NO: 1457 - protein, 9 aa, Artificial Sequence
  Cyclicized modulating agent comprising desmocollin-1 cell adhesion recognition sequence
KYATTADGE

SEQ ID NO: 1458 - protein, 6 aa, Artificial Sequence
  Cyclicized modulating agent comprising desmocollin-1 cell adhesion recognition sequence
KGYATE

SEQ ID NO: 1459 - protein, 7 aa, Artificial Sequence
  Cyclicized modulating agent comprising desmocollin-1 cell adhesion recognition sequence
KGYATTE

SEQ ID NO: 1460 - protein, 8 aa, Artificial Sequence
  Cyclicized modulating agent comprising desmocollin-1 cell adhesion recognition sequence
KGYATTAE

SEQ ID NO: 1461 - protein, 9 aa, Artificial Sequence
  Cyclicized modulating agent comprising desmocollin-1 cell adhesion recognition sequence
KGYATTADE

SEQ ID NO: 1462 - protein, 10 aa, Artificial Sequence
  Cyclicized modulating agent comprising desmocollin-1 cell adhesion recognition sequence
KGYATTADGE

SEQ ID NO: 1463 - protein, 6 aa, Artificial Sequence
  Cyclicized modulating agent comprising desmocollin-1 cell adhesion recognition sequence
KAYATE

SEQ ID NO: 1464 - protein, 7 aa, Artificial Sequence
  Cyclicized modulating agent comprising desmocollin-1 cell adhesion recognition sequence
KAYATTE

SEQ ID NO: 1465 - protein, 8 aa, Artificial Sequence
  Cyclicized modulating agent comprising desmocollin-1 cell adhesion recognition sequence
KAYATTAE

SEQ ID NO: 1466 - protein, 9 aa, Artificial Sequence
  Cyclicized modulating agent comprising desmocollin-1 cell adhesion recognition sequence
KAYATTADE

SEQ ID NO: 1467 - protein, 10 aa, Artificial Sequence
  Cyclicized modulating agent comprising desmocollin-1 cell adhesion recognition sequence
KAYATTADGE

SEQ ID NO: 1468 - protein, 7 aa, Artificial Sequence
  Cyclicized modulating agent comprising desmocollin-1 cell adhesion recognition sequence
KYGYATE

SEQ ID NO: 1469 - protein, 8 aa, Artificial Sequence
  Cyclicized modulating agent comprising desmocollin-1 cell adhesion recognition sequence
KYGYATTE

SEQ ID NO: 1470 - protein, 9 aa, Artificial Sequence
  Cyclicized modulating agent comprising desmocollin-1 cell adhesion recognition sequence
KYGYATTAE

SEQ ID NO: 1471 - protein, 10 aa, Artificial Sequence
  Cyclicized modulating agent comprising desmocollin-1 cell adhesion recognition sequence
KYGYATTADE

SEQ ID NO: 1472 - protein, 11 aa, Artificial Sequence
  Cyclicized modulating agent comprising desmocollin-1 cell adhesion recognition sequence
KYGYATTADGE

SEQ ID NO: 1473 - protein, 7 aa, Artificial Sequence
  Cyclicized modulating agent comprising desmocollin-1 cell adhesion recognition sequence
KYAYATE

SEQ ID NO: 1474 - protein, 8 aa, Artificial Sequence
  Cyclicized modulating agent comprising desmocollin-1 cell adhesion recognition sequence
KYAYATTE

SEQ ID NO: 1475 - protein, 9 aa, Artificial Sequence
  Cyclicized modulating agent comprising desmocollin-1 cell adhesion recognition sequence
KYAYATTAE

SEQ ID NO: 1476 - protein, 10 aa, Artificial Sequence
  Cyclicized modulating agent comprising desmocollin-1 cell adhesion recognition sequence
KYAYATTADE

SEQ ID NO: 1477 - protein, 11 aa, Artificial Sequence
  Cyclicized modulating agent comprising desmocollin-1 cell adhesion recognition sequence
KYAYATTADGE

SEQ ID NO: 1478 - protein, 8 aa, Artificial Sequence
  Cyclicized modulating agent comprising desmocollin-1 cell adhesion recognition sequence
KLYGYATE

SEQ ID NO: 1479 - protein, 9 aa, Artificial Sequence
  Cyclicized modulating agent comprising desmocollin-1 cell adhesion recognition sequence
KLYGYATTE

SEQ ID NO: 1480 - protein, 10 aa, Artificial Sequence
  Cyclicized modulating agent comprising desmocollin-1 cell adhesion recognition sequence
KLYGYATTAE

SEQ ID NO: 1481 - protein, 11 aa, Artificial Sequence
  Cyclicized modulating agent comprising desmocollin-1 cell adhesion recognition sequence
KLYGYATTADE

SEQ ID NO: 1482 - protein, 12 aa, Artificial Sequence
  Cyclicized modulating agent comprising desmocollin-1 cell adhesion recognition sequence
KLYGYATTADGE

SEQ ID NO: 1483 - protein, 8 aa, Artificial Sequence
  Cyclicized modulating agent comprising desmocollin-1 cell adhesion recognition sequence
KLYAYATE

SEQ ID NO: 1484 - protein, 9 aa, Artificial Sequence
  Cyclicized modulating agent comprising desmocollin-1 cell adhesion recognition sequence
KLYAYATTE

SEQ ID NO: 1485 - protein, 10 aa, Artificial Sequence
  Cyclicized modulating agent comprising desmocollin-1 cell adhesion recognition sequence
KLYAYATTAE

SEQ ID NO: 1486 - protein, 11 aa, Artificial Sequence
  Cyclicized modulating agent comprising desmocollin-1 cell adhesion recognition sequence
KLYAYATTADE

SEQ ID NO: 1487 - protein, 12 aa, Artificial Sequence
  Cyclicized modulating agent comprising desmocollin-1 cell adhesion recognition sequence
KLYAYATTADGE

SEQ ID NO: 1488 - protein, 8 aa, Artificial Sequence
  Cyclicized modulating agent comprising desmocollin-1 cell adhesion recognition sequence
KVYGYATE

SEQ ID NO: 1489 - protein, 9 aa, Artificial Sequence
  Cyclicized modulating agent comprising desmocollin-1 cell adhesion recognition sequence
KVYGYATTE

SEQ ID NO: 1490 - protein, 10 aa, Artificial Sequence
  Cyclicized modulating agent comprising desmocollin-1 cell adhesion recognition sequence
KVYGYATTAE

SEQ ID NO: 1491 - protein, 11 aa, Artificial Sequence
  Cyclicized modulating agent comprising desmocollin-1 cell adhesion recognition sequence
KVYGYATTADE

SEQ ID NO: 1492 - protein, 12 aa, Artificial Sequence
  Cyclicized modulating agent comprising desmocollin-1 cell adhesion recognition sequence
KVYGYATTADGE

SEQ ID NO: 1493 - protein, 8 aa, Artificial Sequence
  Cyclicized modulating agent comprising desmocollin-1 cell adhesion recognition sequence
KVYAYATE

SEQ ID NO: 1494 - protein, 9 aa, Artificial Sequence
  Cyclicized modulating agent comprising desmocollin-1 cell adhesion recognition sequence
KVYAYATTE

SEQ ID NO: 1495 - protein, 10 aa, Artificial Sequence
  Cyclicized modulating agent comprising desmocollin-1 cell adhesion recognition sequence
KVYAYATTAE

SEQ ID NO: 1496 - protein, 11 aa, Artificial Sequence
  Cyclicized modulating agent comprising desmocollin-1 cell adhesion recognition sequence
KVYAYATTADE

SEQ ID NO: 1497 - protein, 12 aa, Artificial Sequence
  Cyclicized modulating agent comprising desmocollin-1 cell adhesion recognition sequence
KVYAYATTADGE

SEQ ID NO: 1498 - protein, 8 aa, Artificial Sequence
  Cyclicized modulating agent comprising desmocollin-1 cell adhesion recognition sequence
KIYGYATE

SEQ ID NO: 1499 - protein, 9 aa, Artificial Sequence
  Cyclicized modulating agent comprising desmocollin-1 cell adhesion recognition sequence
KIYGYATTE

SEQ ID NO: 1500 - protein, 10 aa, Artificial Sequence
  Cyclicized modulating agent comprising desmocollin-1 cell adhesion recognition sequence
KIYGYATTAE

SEQ ID NO: 1501 - protein, 11 aa, Artificial Sequence
  Cyclicized modulating agent comprising desmocollin-1 cell adhesion recognition sequence
KIYGYATTADE

SEQ ID NO: 1502 - protein, 12 aa, Artificial Sequence
  Cyclicized modulating agent comprising desmocollin-1 cell adhesion recognition sequence
KIYGYATTADGE

SEQ ID NO: 1503 - protein, 8 aa, Artificial Sequence
  Cyclicized modulating agent comprising desmocollin-1 cell adhesion recognition sequence
KIYAYATE

SEQ ID NO: 1504 - protein, 9 aa, Artificial Sequence
  Cyclicized modulating agent comprising desmocollin-1 cell adhesion recognition sequence
KIYAYATTE

SEQ ID NO: 1505 - protein, 10 aa, Artificial Sequence
  Cyclicized modulating agent comprising desmocollin-1 cell adhesion recognition sequence
KIYAYATTAE

SEQ ID NO: 1506 - protein, 11 aa, Artificial Sequence
  Cyclicized modulating agent comprising desmocollin-1 cell adhesion recognition sequence
KIYAYATTADE

SEQ ID NO: 1507 - protein, 12 aa, Artificial Sequence
  Cyclicized modulating agent comprising desmocollin-1 cell adhesion recognition sequence
KIYAYATTADGE

SEQ ID NO: 1508 - protein, 5 aa, Artificial Sequence
  Cyclicized modulating agent comprising desmocollin-1 cell adhesion recognition sequence
DYATK

SEQ ID NO: 1509 - protein, 6 aa, Artificial Sequence
  Cyclicized modulating agent comprising desmocollin-1 cell adhesion recognition sequence
DYATTK

SEQ ID NO: 1510 - protein, 7 aa, Artificial Sequence
  Cyclicized modulating agent comprising desmocollin-1 cell adhesion recognition sequence
DYATTAK

SEQ ID NO: 1511 - protein, 8 aa, Artificial Sequence
  Cyclicized modulating agent comprising desmocollin-1 cell adhesion recognition sequence
DYATTADK

SEQ ID NO: 1512 - protein, 9 aa, Artificial Sequence
  Cyclicized modulating agent comprising desmocollin-1 cell adhesion recognition sequence
DYATTADGK

SEQ ID NO: 1513 - protein, 6 aa, Artificial Sequence
  Cyclicized modulating agent comprising desmocollin-1 cell adhesion recognition sequence
DGYATK

SEQ ID NO: 1514 - protein, 7 aa, Artificial Sequence
  Cyclicized modulating agent comprising desmocollin-1 cell adhesion recognition sequence
DGYATTK

SEQ ID NO: 1515 - protein, 8 aa, Artificial Sequence
  Cyclicized modulating agent comprising desmocollin-1 cell adhesion recognition sequence
DGYATTAK

SEQ ID NO: 1516 - protein, 9 aa, Artificial Sequence
  Cyclicized modulating agent comprising desmocollin-1 cell adhesion recognition sequence
DGYATTADK

SEQ ID NO: 1517 - protein, 10 aa, Artificial Sequence
  Cyclicized modulating agent comprising desmocollin-1 cell adhesion recognition sequence
DGYATTADGK

SEQ ID NO: 1518 - protein, 6 aa, Artificial Sequence
  Cyclicized modulating agent comprising desmocollin-1 cell adhesion recognition sequence
DAYATK

SEQ ID NO: 1519 - protein, 7 aa, Artificial Sequence
  Cyclicized modulating agent comprising desmocollin-1 cell adhesion recognition sequence
DAYATTK

SEQ ID NO: 1520 - protein, 8 aa, Artificial Sequence
  Cyclicized modulating agent comprising desmocollin-1 cell adhesion recognition sequence
DAYATTAK

SEQ ID NO: 1521 - protein, 9 aa, Artificial Sequence
  Cyclicized modulating agent comprising desmocollin-1 cell adhesion recognition sequence
DAYATTADK

SEQ ID NO: 1522 - protein, 10 aa, Artificial Sequence
  Cyclicized modulating agent comprising desmocollin-1 cell adhesion recognition sequence
DAYATTADGK

SEQ ID NO: 1523 - protein, 7 aa, Artificial Sequence
  Cyclicized modulating agent comprising desmocollin-1 cell adhesion recognition sequence
DYGYATK

SEQ ID NO: 1524 - protein, 8 aa, Artificial Sequence
  Cyclicized modulating agent comprising desmocollin-1 cell adhesion recognition sequence
DYGYATTK

SEQ ID NO: 1525 - protein, 9 aa, Artificial Sequence
  Cyclicized modulating agent comprising desmocollin-1 cell adhesion recognition sequence
DYGYATTAK

SEQ ID NO: 1526 - protein, 10 aa, Artificial Sequence
  Cyclicized modulating agent comprising desmocollin-1 cell adhesion recognition sequence
DYGYATTADK

SEQ ID NO: 1527 - protein, 11 aa, Artificial Sequence
  Cyclicized modulating agent comprising desmocollin-1 cell adhesion recognition sequence
DYGYATTADGK

SEQ ID NO: 1528 - protein, 7 aa, Artificial Sequence
  Cyclicized modulating agent comprising desmocollin-1 cell adhesion recognition sequence
DYAYATK

SEQ ID NO: 1529 - protein, 8 aa, Artificial Sequence
  Cyclicized modulating agent comprising desmocollin-1 cell adhesion recognition sequence
DYAYATTK

SEQ ID NO: 1530 - protein, 9 aa, Artificial Sequence
  Cyclicized modulating agent comprising desmocollin-1 cell adhesion recognition sequence
DYAYATTAK

SEQ ID NO: 1531 - protein, 10 aa, Artificial Sequence
  Cyclicized modulating agent comprising desmocollin-1 cell adhesion recognition sequence
DYAYATTADK

SEQ ID NO: 1532 - protein, 11 aa, Artificial Sequence
  Cyclicized modulating agent comprising desmocollin-1 cell adhesion recognition sequence
DYAYATTADGK

SEQ ID NO: 1533 - protein, 8 aa, Artificial Sequence
  Cyclicized modulating agent comprising desmocollin-1 cell adhesion recognition sequence
DLYGYATK

SEQ ID NO: 1534 - protein, 9 aa, Artificial Sequence
  Cyclicized modulating agent comprising desmocollin-1 cell adhesion recognition sequence
DLYGYATTK

SEQ ID NO: 1535 - protein, 10 aa, Artificial Sequence
  Cyclicized modulating agent comprising desmocollin-1 cell adhesion recognition sequence
DLYGYATTAK

SEQ ID NO: 1536 - protein, 11 aa, Artificial Sequence
  Cyclicized modulating agent comprising desmocollin-1 cell adhesion recognition sequence
DLYGYATTADK

SEQ ID NO: 1537 - protein, 12 aa, Artificial Sequence
  Cyclicized modulating agent comprising desmocollin-1 cell adhesion recognition sequence
DLYGYATTADGK

SEQ ID NO: 1538 - protein, 8 aa, Artificial Sequence
  Cyclicized modulating agent comprising desmocollin-1 cell adhesion recognition sequence
DLYAYATK

SEQ ID NO: 1539 - protein, 9 aa, Artificial Sequence
  Cyclicized modulating agent comprising desmocollin-1 cell adhesion recognition sequence
DLYAYATTK

SEQ ID NO: 1540 - protein, 10 aa, Artificial Sequence
  Cyclicized modulating agent comprising desmocollin-1 cell adhesion recognition sequence
DLYAYATTAK

SEQ ID NO: 1541 - protein, 11 aa, Artificial Sequence
  Cyclicized modulating agent comprising desmocollin-1 cell adhesion recognition sequence
DLYAYATTADK

SEQ ID NO: 1542 - protein, 12 aa, Artificial Sequence
  Cyclicized modulating agent comprising desmocollin-1 cell adhesion recognition sequence
DLYAYATTADGK

SEQ ID NO: 1543 - protein, 8 aa, Artificial Sequence
  Cyclicized modulating agent comprising desmocollin-1 cell adhesion recognition sequence
DVYGYATK

SEQ ID NO: 1544 - protein, 9 aa, Artificial Sequence
  Cyclicized modulating agent comprising desmocollin-1 cell adhesion recognition sequence
DVYGYATTK

SEQ ID NO: 1545 - protein, 10 aa, Artificial Sequence
  Cyclicized modulating agent comprising desmocollin-1 cell adhesion recognition sequence
DVYGYATTAK

SEQ ID NO: 1546 - protein, 11 aa, Artificial Sequence
  Cyclicized modulating agent comprising desmocollin-1 cell adhesion recognition sequence
DVYGYATTADK

SEQ ID NO: 1547 - protein, 12 aa, Artificial Sequence
  Cyclicized modulating agent comprising desmocollin-1 cell adhesion recognition sequence
DVYGYATTADGK

SEQ ID NO: 1548 - protein, 8 aa, Artificial Sequence
  Cyclicized modulating agent comprising desmocollin-1 cell adhesion recognition sequence
DVYAYATK

SEQ ID NO: 1549 - protein, 9 aa, Artificial Sequence
  Cyclicized modulating agent comprising desmocollin-1 cell adhesion recognition sequence
DVYAYATTK

SEQ ID NO: 1550 - protein, 10 aa, Artificial Sequence
  Cyclicized modulating agent comprising desmocollin-1 cell adhesion recognition sequence
DVYAYATTAK

SEQ ID NO: 1551 - protein, 11 aa, Artificial Sequence
  Cyclicized modulating agent comprising desmocollin-1 cell adhesion recognition sequence
DVYAYATTADK

SEQ ID NO: 1552 - protein, 12 aa, Artificial Sequence
  Cyclicized modulating agent comprising desmocollin-1 cell adhesion recognition sequence
DVYAYATTADGK

SEQ ID NO: 1553 - protein, 8 aa, Artificial Sequence
  Cyclicized modulating agent comprising desmocollin-1 cell adhesion recognition sequence
DIYGYATK

SEQ ID NO: 1554 - protein, 9 aa, Artificial Sequence
  Cyclicized modulating agent comprising desmocollin-1 cell adhesion recognition sequence
DIYGYATTK

SEQ ID NO: 1555 - protein, 10 aa, Artificial Sequence
  Cyclicized modulating agent comprising desmocollin-1 cell adhesion recognition sequence
DIYGYATTAK

SEQ ID NO: 1556 - protein, 11 aa, Artificial Sequence
  Cyclicized modulating agent comprising desmocollin-1 cell adhesion recognition sequence
DIYGYATTADK

SEQ ID NO: 1557 - protein, 12 aa, Artificial Sequence
  Cyclicized modulating agent comprising desmocollin-1 cell adhesion recognition sequence
DIYGYATTADGK

SEQ ID NO: 1558 - protein, 8 aa, Artificial Sequence
  Cyclicized modulating agent comprising desmocollin-1 cell adhesion recognition sequence
DIYAYATK

SEQ ID NO: 1559 - protein, 9 aa, Artificial Sequence
  Cyclicized modulating agent comprising desmocollin-1 cell adhesion recognition sequence
DIYAYATTK

SEQ ID NO: 1560 - protein, 10 aa, Artificial Sequence
  Cyclicized modulating agent comprising desmocollin-1 cell adhesion recognition sequence
DIYAYATTAK

SEQ ID NO: 1561 - protein, 11 aa, Artificial Sequence
  Cyclicized modulating agent comprising desmocollin-1 cell adhesion recognition sequence
DIYAYATTADK

SEQ ID NO: 1562 - protein, 12 aa, Artificial Sequence
  Cyclicized modulating agent comprising desmocollin-1 cell adhesion recognition sequence
DIYAYATTADGK

SEQ ID NO: 1563 - protein, 5 aa, Artificial Sequence
  Cyclicized modulating agent comprising desmocollin-1 cell adhesion recognition sequence
KYATD

SEQ ID NO: 1564 - protein, 6 aa, Artificial Sequence
  Cyclicized modulating agent comprising desmocollin-1 cell adhesion recognition sequence
KYATTD

SEQ ID NO: 1565 - protein, 7 aa, Artificial Sequence
  Cyclicized modulating agent comprising desmocollin-1 cell adhesion recognition sequence
KYATTAD

SEQ ID NO: 1566 - protein, 8 aa, Artificial Sequence
  Cyclicized modulating agent comprising desmocollin-1 cell adhesion recognition sequence
KYATTADD

SEQ ID NO: 1567 - protein, 9 aa, Artificial Sequence
  Cyclicized modulating agent comprising desmocollin-1 cell adhesion recognition sequence
KYATTADGD

SEQ ID NO: 1568 - protein, 6 aa, Artificial Sequence
  Cyclicized modulating agent comprising desmocollin-1 cell adhesion recognition sequence
KGYATD

SEQ ID NO: 1569 - protein, 7 aa, Artificial Sequence
  Cyclicized modulating agent comprising desmocollin-1 cell adhesion recognition sequence
KGYATTD

SEQ ID NO: 1570 - protein, 8 aa, Artificial Sequence
  Cyclicized modulating agent comprising desmocollin-1 cell adhesion recognition sequence
KGYATTAD

SEQ ID NO: 1571 - protein, 9 aa, Artificial Sequence
  Cyclicized modulating agent comprising desmocollin-1 cell adhesion recognition sequence
KGYATTADD

SEQ ID NO: 1572 - protein, 10 aa, Artificial Sequence
  Cyclicized modulating agent comprising desmocollin-1 cell adhesion recognition sequence
KGYATTADGD

SEQ ID NO: 1573 - protein, 6 aa, Artificial Sequence
  Cyclicized modulating agent comprising desmocollin-1 cell adhesion recognition sequence
KAYATD

SEQ ID NO: 1574 - protein, 7 aa, Artificial Sequence
  Cyclicized modulating agent comprising desmocollin-1 cell adhesion recognition sequence
KAYATTD

SEQ ID NO: 1575 - protein, 8 aa, Artificial Sequence
  Cyclicized modulating agent comprising desmocollin-1 cell adhesion recognition sequence
KAYATTAD

SEQ ID NO: 1576 - protein, 9 aa, Artificial Sequence
  Cyclicized modulating agent comprising desmocollin-1 cell adhesion recognition sequence
KAYATTADD

SEQ ID NO: 1577 - protein, 10 aa, Artificial Sequence
  Cyclicized modulating agent comprising desmocollin-1 cell adhesion recognition sequence
KAYATTADGD

SEQ ID NO: 1578 - protein, 7 aa, Artificial Sequence
  Cyclicized modulating agent comprising desmocollin-1 cell adhesion recognition sequence
KYGYATD

SEQ ID NO: 1579 - protein, 8 aa, Artificial Sequence
  Cyclicized modulating agent comprising desmocollin-1 cell adhesion recognition sequence
KYGYATTD

SEQ ID NO: 1580 - protein, 9 aa, Artificial Sequence
  Cyclicized modulating agent comprising desmocollin-1 cell adhesion recognition sequence
KYGYATTAD

SEQ ID NO: 1581 - protein, 10 aa, Artificial Sequence
  Cyclicized modulating agent comprising desmocollin-1 cell adhesion recognition sequence
KYGYATTADD

SEQ ID NO: 1582 - protein, 11 aa, Artificial Sequence
  Cyclicized modulating agent comprising desmocollin-1 cell adhesion recognition sequence
KYGYATTADGD

SEQ ID NO: 1583 - protein, 7 aa, Artificial Sequence
  Cyclicized modulating agent comprising desmocollin-1 cell adhesion recognition sequence
KYAYATD

SEQ ID NO: 1584 - protein, 8 aa, Artificial Sequence
  Cyclicized modulating agent comprising desmocollin-1 cell adhesion recognition sequence
KYAYATTD

SEQ ID NO: 1585 - protein, 9 aa, Artificial Sequence
  Cyclicized modulating agent comprising desmocollin-1 cell adhesion recognition sequence
KYAYATTAD

SEQ ID NO: 1586 - protein, 10 aa, Artificial Sequence
  Cyclicized modulating agent comprising desmocollin-1 cell adhesion recognition sequence
KYAYATTADD

SEQ ID NO: 1587 - protein, 11 aa, Artificial Sequence
  Cyclicized modulating agent comprising desmocollin-1 cell adhesion recognition sequence
KYAYATTADGD

SEQ ID NO: 1588 - protein, 8 aa, Artificial Sequence
  Cyclicized modulating agent comprising desmocollin-1 cell adhesion recognition sequence
KLYGYATD

SEQ ID NO: 1589 - protein, 9 aa, Artificial Sequence
  Cyclicized modulating agent comprising desmocollin-1 cell adhesion recognition sequence
KLYGYATTD

SEQ ID NO: 1590 - protein, 10 aa, Artificial Sequence
  Cyclicized modulating agent comprising desmocollin-1 cell adhesion recognition sequence
KLYGYATTAD

SEQ ID NO: 1591 - protein, 11 aa, Artificial Sequence
  Cyclicized modulating agent comprising desmocollin-1 cell adhesion recognition sequence
KLYGYATTADD

SEQ ID NO: 1592 - protein, 12 aa, Artificial Sequence
  Cyclicized modulating agent comprising desmocollin-1 cell adhesion recognition sequence
KLYGYATTADGD

SEQ ID NO: 1593 - protein, 8 aa, Artificial Sequence
  Cyclicized modulating agent comprising desmocollin-1 cell adhesion recognition sequence
KLYAYATD

SEQ ID NO: 1594 - protein, 9 aa, Artificial Sequence
  Cyclicized modulating agent comprising desmocollin-1 cell adhesion recognition sequence
KLYAYATTD

SEQ ID NO: 1595 - protein, 10 aa, Artificial Sequence
  Cyclicized modulating agent comprising desmocollin-1 cell adhesion recognition sequence
KLYAYATTAD

SEQ ID NO: 1596 - protein, 11 aa, Artificial Sequence
  Cyclicized modulating agent comprising desmocollin-1 cell adhesion recognition sequence
KLYAYATTADD

SEQ ID NO: 1597 - protein, 12 aa, Artificial Sequence
  Cyclicized modulating agent comprising desmocollin-1 cell adhesion recognition sequence
KLYAYATTADGD

SEQ ID NO: 1598 - protein, 8 aa, Artificial Sequence
  Cyclicized modulating agent comprising desmocollin-1 cell adhesion recognition sequence
KVYGYATD

SEQ ID NO: 1599 - protein, 9 aa, Artificial Sequence
  Cyclicized modulating agent comprising desmocollin-1 cell adhesion recognition sequence
KVYGYATTD

SEQ ID NO: 1600 - protein, 10 aa, Artificial Sequence
  Cyclicized modulating agent comprising desmocollin-1 cell adhesion recognition sequence
KVYGYATTAD

SEQ ID NO: 1601 - protein, 11 aa, Artificial Sequence
  Cyclicized modulating agent comprising desmocollin-1 cell adhesion recognition sequence
KVYGYATTADD

SEQ ID NO: 1602 - protein, 12 aa, Artificial Sequence
  Cyclicized modulating agent comprising desmocollin-1 cell adhesion recognition sequence
KVYGYATTADGD

SEQ ID NO: 1603 - protein, 8 aa, Artificial Sequence
  Cyclicized modulating agent comprising desmocollin-1 cell adhesion recognition sequence
KVYAYATD

SEQ ID NO: 1604 - protein, 9 aa, Artificial Sequence
  Cyclicized modulating agent comprising desmocollin-1 cell adhesion recognition sequence
KVYAYATTD

SEQ ID NO: 1605 - protein, 10 aa, Artificial Sequence
  Cyclicized modulating agent comprising desmocollin-1 cell adhesion recognition sequence
KVYAYATTAD

SEQ ID NO: 1606 - protein, 11 aa, Artificial Sequence
  Cyclicized modulating agent comprising desmocollin-1 cell adhesion recognition sequence
KVYAYATTADD

SEQ ID NO: 1607 - protein, 12 aa, Artificial Sequence
  Cyclicized modulating agent comprising desmocollin-1 cell adhesion recognition sequence
KVYAYATTADGD

SEQ ID NO: 1608 - protein, 8 aa, Artificial Sequence
  Cyclicized modulating agent comprising desmocollin-1 cell adhesion recognition sequence
KIYGYATD

SEQ ID NO: 1609 - protein, 9 aa, Artificial Sequence
  Cyclicized modulating agent comprising desmocollin-1 cell adhesion recognition sequence
KIYGYATTD

SEQ ID NO: 1610 - protein, 10 aa, Artificial Sequence
  Cyclicized modulating agent comprising desmocollin-1 cell adhesion recognition sequence
KIYGYATTAD

SEQ ID NO: 1611 - protein, 11 aa, Artificial Sequence
  Cyclicized modulating agent comprising desmocollin-1 cell adhesion recognition sequence
KIYGYATTADD

SEQ ID NO: 1612 - protein, 12 aa, Artificial Sequence
  Cyclicized modulating agent comprising desmocollin-1 cell adhesion recognition sequence
KIYGYATTADGD

SEQ ID NO: 1613 - protein, 8 aa, Artificial Sequence
  Cyclicized modulating agent comprising desmocollin-1 cell adhesion recognition sequence
KIYAYATD

SEQ ID NO: 1614 - protein, 9 aa, Artificial Sequence
  Cyclicized modulating agent comprising desmocollin-1 cell adhesion recognition sequence
KIYAYATTD

SEQ ID NO: 1615 - protein, 10 aa, Artificial Sequence
  Cyclicized modulating agent comprising desmocollin-1 cell adhesion recognition sequence
KIYAYATTAD

SEQ ID NO: 1616 - protein, 11 aa, Artificial Sequence
  Cyclicized modulating agent comprising desmocollin-1 cell adhesion recognition sequence
KIYAYATTADD

SEQ ID NO: 1617 - protein, 12 aa, Artificial Sequence
  Cyclicized modulating agent comprising desmocollin-1 cell adhesion recognition sequence
KIYAYATTADGD

SEQ ID NO: 1618 - protein, 5 aa, Artificial Sequence
  Cyclicized modulating agent comprising desmocollin-1 cell adhesion recognition sequence
YATTA

SEQ ID NO: 1619 - protein, 6 aa, Artificial Sequence
  Cyclicized modulating agent comprising desmocollin-1 cell adhesion recognition sequence
YATTAD

SEQ ID NO: 1620 - protein, 7 aa, Artificial Sequence
  Cyclicized modulating agent comprising desmocollin-1 cell adhesion recognition sequence
YATTADG

SEQ ID NO: 1621 - protein, 5 aa, Artificial Sequence
  Cyclicized modulating agent comprising desmocollin-1 cell adhesion recognition sequence
GYATT

SEQ ID NO: 1622 - protein, 6 aa, Artificial Sequence
  Cyclicized modulating agent comprising desmocollin-1 cell adhesion recognition sequence
GYATTA

SEQ ID NO: 1623 - protein, 7 aa, Artificial Sequence
  Cyclicized modulating agent comprising desmocollin-1 cell adhesion recognition sequence
GYATTAD

SEQ ID NO: 1624 - protein, 8 aa, Artificial Sequence
  Cyclicized modulating agent comprising desmocollin-1 cell adhesion recognition sequence
GYATTADG

SEQ ID NO: 1625 - protein, 5 aa, Artificial Sequence
  Cyclicized modulating agent comprising desmocollin-1 cell adhesion recognition sequence
AYATT

SEQ ID NO: 1626 - protein, 6 aa, Artificial Sequence
  Cyclicized modulating agent comprising desmocollin-1 cell adhesion recognition sequence
AYATTA

SEQ ID NO: 1627 - protein, 7 aa, Artificial Sequence
  Cyclicized modulating agent comprising desmocollin-1 cell adhesion recognition sequence
AYATTAD

SEQ ID NO: 1628 - protein, 8 aa, Artificial Sequence
  Cyclicized modulating agent comprising desmocollin-1 cell adhesion recognition sequence
AYATTADG

SEQ ID NO: 1629 - protein, 5 aa, Artificial Sequence
  Cyclicized modulating agent comprising desmocollin-1 cell adhesion recognition sequence
YGYAT

SEQ ID NO: 1630 - protein, 6 aa, Artificial Sequence
  Cyclicized modulating agent comprising desmocollin-1 cell adhesion recognition sequence
YGYATT

SEQ ID NO: 1631 - protein, 7 aa, Artificial Sequence
  Cyclicized modulating agent comprising desmocollin-1 cell adhesion recognition sequence
YGYATTA

SEQ ID NO: 1632 - protein, 8 aa, Artificial Sequence
  Cyclicized modulating agent comprising desmocollin-1 cell adhesion recognition sequence
YGYATTAD

SEQ ID NO: 1633 - protein, 9 aa, Artificial Sequence
  Cyclicized modulating agent comprising desmocollin-1 cell adhesion recognition sequence
YGYATTADG

SEQ ID NO: 1634 - protein, 5 aa, Artificial Sequence
  Cyclicized modulating agent comprising desmocollin-1 cell adhesion recognition sequence
YAYAT

SEQ ID NO: 1635 - protein, 6 aa, Artificial Sequence
  Cyclicized modulating agent comprising desmocollin-1 cell adhesion recognition sequence
YAYATT

SEQ ID NO: 1636 - protein, 7 aa, Artificial Sequence
  Cyclicized modulating agent comprising desmocollin-1 cell adhesion recognition sequence
YAYATTA

SEQ ID NO: 1637 - protein, 8 aa, Artificial Sequence
  Cyclicized modulating agent comprising desmocollin-1 cell adhesion recognition sequence
YAYATTAD

SEQ ID NO: 1638 - protein, 9 aa, Artificial Sequence
  Cyclicized modulating agent comprising desmocollin-1 cell adhesion recognition sequence
YAYATTADG

SEQ ID NO: 1639 - protein, 6 aa, Artificial Sequence
  Cyclicized modulating agent comprising desmocollin-1 cell adhesion recognition sequence
LYGYAT

SEQ ID NO: 1640 - protein, 7 aa, Artificial Sequence
  Cyclicized modulating agent comprising desmocollin-1 cell adhesion recognition sequence
LYGYATT

SEQ ID NO: 1641 - protein, 8 aa, Artificial Sequence
  Cyclicized modulating agent comprising desmocollin-1 cell adhesion recognition sequence
LYGYATTA

SEQ ID NO: 1642 - protein, 9 aa, Artificial Sequence
  Cyclicized modulating agent comprising desmocollin-1 cell adhesion recognition sequence
LYGYATTAD

SEQ ID NO: 1643 - protein, 10 aa, Artificial Sequence
  Cyclicized modulating agent comprising desmocollin-1 cell adhesion recognition sequence
LYGYATTADG

SEQ ID NO: 1644 - protein, 6 aa, Artificial Sequence
  Cyclicized modulating agent comprising desmocollin-1 cell adhesion recognition sequence
LYAYAT

SEQ ID NO: 1645 - protein, 7 aa, Artificial Sequence
  Cyclicized modulating agent comprising desmocollin-1 cell adhesion recognition sequence
LYAYATT

SEQ ID NO: 1646 - protein, 8 aa, Artificial Sequence
  Cyclicized modulating agent comprising desmocollin-1 cell adhesion recognition sequence
LYAYATTA

SEQ ID NO: 1647 - protein, 9 aa, Artificial Sequence
  Cyclicized modulating agent comprising desmocollin-1 cell adhesion recognition sequence
LYAYATTAD

SEQ ID NO: 1648 - protein, 10 aa, Artificial Sequence
  Cyclicized modulating agent comprising desmocollin-1 cell adhesion recognition sequence
LYAYATTADG

SEQ ID NO: 1649 - protein, 6 aa, Artificial Sequence
  Cyclicized modulating agent comprising desmocollin-1 cell adhesion recognition sequence
VYGYAT

SEQ ID NO: 1650 - protein, 7 aa, Artificial Sequence
  Cyclicized modulating agent comprising desmocollin-1 cell adhesion recognition sequence
VYGYATT

SEQ ID NO: 1651 - protein, 8 aa, Artificial Sequence
  Cyclicized modulating agent comprising desmocollin-1 cell adhesion recognition sequence
VYGYATTA

SEQ ID NO: 1652 - protein, 9 aa, Artificial Sequence
  Cyclicized modulating agent comprising desmocollin-1 cell adhesion recognition sequence
VYGYATTAD

SEQ ID NO: 1653 - protein, 10 aa, Artificial Sequence
  Cyclicized modulating agent comprising desmocollin-1 cell adhesion recognition sequence
VYGYATTADG

SEQ ID NO: 1654 - protein, 6 aa, Artificial Sequence
  Cyclicized modulating agent comprising desmocollin-1 cell adhesion recognition sequence
VYAYAT

SEQ ID NO: 1655 - protein, 7 aa, Artificial Sequence
  Cyclicized modulating agent comprising desmocollin-1 cell adhesion recognition sequence
VYAYATT

SEQ ID NO: 1656 - protein, 8 aa, Artificial Sequence
  Cyclicized modulating agent comprising desmocollin-1 cell adhesion recognition sequence
VYAYATTA

SEQ ID NO: 1657 - protein, 9 aa, Artificial Sequence
  Cyclicized modulating agent comprising desmocollin-1 cell adhesion recognition sequence
VYAYATTAD

SEQ ID NO: 1658 - protein, 10 aa, Artificial Sequence
  Cyclicized modulating agent comprising desmocollin-1 cell adhesion recognition sequence
VYAYATTADG

SEQ ID NO: 1659 - protein, 6 aa, Artificial Sequence
  Cyclicized modulating agent comprising desmocollin-1 cell adhesion recognition sequence
IYGYAT

SEQ ID NO: 1660 - protein, 7 aa, Artificial Sequence
  Cyclicized modulating agent comprising desmocollin-1 cell adhesion recognition sequence
IYGYATT

SEQ ID NO: 1661 - protein, 8 aa, Artificial Sequence
  Cyclicized modulating agent comprising desmocollin-1 cell adhesion recognition sequence
IYGYATTA

SEQ ID NO: 1662 - protein, 9 aa, Artificial Sequence
  Cyclicized modulating agent comprising desmocollin-1 cell adhesion recognition sequence
IYGYATTAD

SEQ ID NO: 1663 - protein, 10 aa, Artificial Sequence
  Cyclicized modulating agent comprising desmocollin-1 cell adhesion recognition sequence
IYGYATTADG

SEQ ID NO: 1664 - protein, 6 aa, Artificial Sequence
  Cyclicized modulating agent comprising desmocollin-1 cell adhesion recognition sequence
IYAYAT

SEQ ID NO: 1665 - protein, 7 aa, Artificial Sequence
  Cyclicized modulating agent comprising desmocollin-1 cell adhesion recognition sequence
IYAYATT

SEQ ID NO: 1666 - protein, 8 aa, Artificial Sequence
  Cyclicized modulating agent comprising desmocollin-1 cell adhesion recognition sequence
IYAYATTA

SEQ ID NO: 1667 - protein, 9 aa, Artificial Sequence
  Cyclicized modulating agent comprising desmocollin-1 cell adhesion recognition sequence
IYAYATTAD

SEQ ID NO: 1668 - protein, 10 aa, Artificial Sequence
  Cyclicized modulating agent comprising desmocollin-1 cell adhesion recognition sequence
IYAYATTADG

SEQ ID NO: 1669 - protein, 5 aa, Artificial Sequence
  Cyclicized modulating agent comprising desmocollin-2 cell adhesion recognition sequence
CFATC

SEQ ID NO: 1670 - protein, 6 aa, Artificial Sequence
  Cyclicized modulating agent comprising desmocollin-2 cell adhesion recognition sequence
CFATTC

SEQ ID NO: 1671 - protein, 7 aa, Artificial Sequence
  Cyclicized modulating agent comprising desmocollin-2 cell adhesion recognition sequence
CFATTPC

SEQ ID NO: 1672 - protein, 8 aa, Artificial Sequence
  Cyclicized modulating agent comprising desmocollin-2 cell adhesion recognition sequence
CFATTPDC

SEQ ID NO: 1673 - protein, 9 aa, Artificial Sequence
  Cyclicized modulating agent comprising desmocollin-2 cell adhesion recognition sequence
CFATTPDGC

SEQ ID NO: 1674 - protein, 6 aa, Artificial Sequence
  Cyclicized modulating agent comprising desmocollin-2 cell adhesion recognition sequence
CAFATC

SEQ ID NO: 1675 - protein, 7 aa, Artificial Sequence
  Cyclicized modulating agent comprising desmocollin-2 cell adhesion recognition sequence
CAFATTC

SEQ ID NO: 1676 - protein, 8 aa, Artificial Sequence
  Cyclicized modulating agent comprising desmocollin-2 cell adhesion recognition sequence
CAFATTPC

SEQ ID NO: 1677 - protein, 9 aa, Artificial Sequence
  Cyclicized modulating agent comprising desmocollin-2 cell adhesion recognition sequence
CAFATTPDC

SEQ ID NO: 1678 - protein, 10 aa, Artificial Sequence
  Cyclicized modulating agent comprising desmocollin-2 cell adhesion recognition sequence
CAFATTPDGC

SEQ ID NO: 1679 - protein, 7 aa, Artificial Sequence
  Cyclicized modulating agent comprising desmocollin-2 cell adhesion recognition sequence
CIAFATC

SEQ ID NO: 1680 - protein, 8 aa, Artificial Sequence
  Cyclicized modulating agent comprising desmocollin-2 cell adhesion recognition sequence
CIAFATTC

SEQ ID NO: 1681 - protein, 9 aa, Artificial Sequence
  Cyclicized modulating agent comprising desmocollin-2 cell adhesion recognition sequence
CIAFATTPC

SEQ ID NO: 1682 - protein, 10 aa, Artificial Sequence
  Cyclicized modulating agent comprising desmocollin-2 cell adhesion recognition sequence
CIAFATTPDC

SEQ ID NO: 1683 - protein, 11 aa, Artificial Sequence
  Cyclicized modulating agent comprising desmocollin-2 cell adhesion recognition sequence
CIAFATTPDGC

SEQ ID NO: 1684 - protein, 8 aa, Artificial Sequence
  Cyclicized modulating agent comprising desmocollin-2 cell adhesion recognition sequence
CIIAFATC

SEQ ID NO: 1685 - protein, 9 aa, Artificial Sequence
  Cyclicized modulating agent comprising desmocollin-2 cell adhesion recognition sequence
CIIAFATTC

SEQ ID NO: 1686 - protein, 10 aa, Artificial Sequence
  Cyclicized modulating agent comprising desmocollin-2 cell adhesion recognition sequence
CIIAFATTPC

SEQ ID NO: 1687 - protein, 11 aa, Artificial Sequence
  Cyclicized modulating agent comprising desmocollin-2 cell adhesion recognition sequence
CIIAFATTPDC

SEQ ID NO: 1688 - protein, 12 aa, Artificial Sequence
  Cyclicized modulating agent comprising desmocollin-2 cell adhesion recognition sequence
CIIAFATTPDGC

SEQ ID NO: 1689 - protein, 8 aa, Artificial Sequence
  Cyclicized modulating agent comprising desmocollin-2 cell adhesion recognition sequence
CLIAFATC

SEQ ID NO: 1690 - protein, 9 aa, Artificial Sequence
  Cyclicized modulating agent comprising desmocollin-2 cell adhesion recognition sequence
CLIAFATTC

SEQ ID NO: 1691 - protein, 10 aa, Artificial Sequence
  Cyclicized modulating agent comprising desmocollin-2 cell adhesion recognition sequence
CLIAFATTPC

SEQ ID NO: 1692 - protein, 11 aa, Artificial Sequence
  Cyclicized modulating agent comprising desmocollin-2 cell adhesion recognition sequence
CLIAFATTPDC

SEQ ID NO: 1693 - protein, 12 aa, Artificial Sequence
  Cyclicized modulating agent comprising desmocollin-2 cell adhesion recognition sequence
CLIAFATTPDGC

SEQ ID NO: 1694 - protein, 5 aa, Artificial Sequence
  Cyclicized modulating agent comprising desmocollin-2 cell adhesion recognition sequence
EFATK

SEQ ID NO: 1695 - protein, 6 aa, Artificial Sequence
  Cyclicized modulating agent comprising desmocollin-2 cell adhesion recognition sequence
EFATTK

SEQ ID NO: 1696 - protein, 7 aa, Artificial Sequence
  Cyclicized modulating agent comprising desmocollin-2 cell adhesion recognition sequence
EFATTPK

SEQ ID NO: 1697 - protein, 8 aa, Artificial Sequence
  Cyclicized modulating agent comprising desmocollin-2 cell adhesion recognition sequence
EFATTPDK

SEQ ID NO: 1698 - protein, 9 aa, Artificial Sequence
  Cyclicized modulating agent comprising desmocollin-2 cell adhesion recognition sequence
EFATTPDGK

SEQ ID NO: 1699 - protein, 6 aa, Artificial Sequence
  Cyclicized modulating agent comprising desmocollin-2 cell adhesion recognition sequence
EAFATK

SEQ ID NO: 1700 - protein, 7 aa, Artificial Sequence
  Cyclicized modulating agent comprising desmocollin-2 cell adhesion recognition sequence
EAFATTK

SEQ ID NO: 1701 - protein, 8 aa, Artificial Sequence
  Cyclicized modulating agent comprising desmocollin-2 cell adhesion recognition sequence
EAFATTPK

SEQ ID NO: 1702 - protein, 9 aa, Artificial Sequence
  Cyclicized modulating agent comprising desmocollin-2 cell adhesion recognition sequence
EAFATTPDK

SEQ ID NO: 1703 - protein, 10 aa, Artificial Sequence
  Cyclicized modulating agent comprising desmocollin-2 cell adhesion recognition sequence
EAFATTPDGK

SEQ ID NO: 1704 - protein, 7 aa, Artificial Sequence
  Cyclicized modulating agent comprising desmocollin-2 cell adhesion recognition sequence
EIAFATK

SEQ ID NO: 1705 - protein, 8 aa, Artificial Sequence
  Cyclicized modulating agent comprising desmocollin-2 cell adhesion recognition sequence
EIAFATTK

SEQ ID NO: 1706 - protein, 9 aa, Artificial Sequence
  Cyclicized modulating agent comprising desmocollin-2 cell adhesion recognition sequence
EIAFATTPK

SEQ ID NO: 1707 - protein, 10 aa, Artificial Sequence
  Cyclicized modulating agent comprising desmocollin-2 cell adhesion recognition sequence
EIAFATTPDK

SEQ ID NO: 1708 - protein, 11 aa, Artificial Sequence
  Cyclicized modulating agent comprising desmocollin-2 cell adhesion recognition sequence
EIAFATTPDGK

SEQ ID NO: 1709 - protein, 8 aa, Artificial Sequence
  Cyclicized modulating agent comprising desmocollin-2 cell adhesion recognition sequence
EIIAFATK

SEQ ID NO: 1710 - protein, 9 aa, Artificial Sequence
  Cyclicized modulating agent comprising desmocollin-2 cell adhesion recognition sequence
EIIAFATTK

SEQ ID NO: 1711 - protein, 10 aa, Artificial Sequence
  Cyclicized modulating agent comprising desmocollin-2 cell adhesion recognition sequence
EIIAFATTPK

SEQ ID NO: 1712 - protein, 11 aa, Artificial Sequence
  Cyclicized modulating agent comprising desmocollin-2 cell adhesion recognition sequence
EIIAFATTPDK

SEQ ID NO: 1713 - protein, 12 aa, Artificial Sequence
  Cyclicized modulating agent comprising desmocollin-2 cell adhesion recognition sequence
EIIAFATTPDGK

SEQ ID NO: 1714 - protein, 8 aa, Artificial Sequence
  Cyclicized modulating agent comprising desmocollin-2 cell adhesion recognition sequence
ELIAFATK

SEQ ID NO: 1715 - protein, 9 aa, Artificial Sequence
  Cyclicized modulating agent comprising desmocollin-2 cell adhesion recognition sequence
ELIAFATTK

SEQ ID NO: 1716 - protein, 10 aa, Artificial Sequence
  Cyclicized modulating agent comprising desmocollin-2 cell adhesion recognition sequence
ELIAFATTPK

SEQ ID NO: 1717 - protein, 11 aa, Artificial Sequence
  Cyclicized modulating agent comprising desmocollin-2 cell adhesion recognition sequence
ELIAFATTPDK

SEQ ID NO: 1718 - protein, 12 aa, Artificial Sequence
  Cyclicized modulating agent comprising desmocollin-2 cell adhesion recognition sequence
ELIAFATTPDGK

SEQ ID NO: 1719 - protein, 5 aa, Artificial Sequence
  Cyclicized modulating agent comprising desmocollin-2 cell adhesion recognition sequence
KFATE

SEQ ID NO: 1720 - protein, 6 aa, Artificial Sequence
  Cyclicized modulating agent comprising desmocollin-2 cell adhesion recognition sequence
KFATTE

SEQ ID NO: 1721 - protein, 7 aa, Artificial Sequence
  Cyclicized modulating agent comprising desmocollin-2 cell adhesion recognition sequence
KFATTPE

SEQ ID NO: 1722 - protein, 8 aa, Artificial Sequence
  Cyclicized modulating agent comprising desmocollin-2 cell adhesion recognition sequence
KFATTPDE

SEQ ID NO: 1723 - protein, 9 aa, Artificial Sequence
  Cyclicized modulating agent comprising desmocollin-2 cell adhesion recognition sequence
KFATTPDGE

SEQ ID NO: 1724 - protein, 6 aa, Artificial Sequence
  Cyclicized modulating agent comprising desmocollin-2 cell adhesion recognition sequence
KAFATE

SEQ ID NO: 1725 - protein, 7 aa, Artificial Sequence
  Cyclicized modulating agent comprising desmocollin-2 cell adhesion recognition sequence
KAFATTE

SEQ ID NO: 1726 - protein, 8 aa, Artificial Sequence
  Cyclicized modulating agent comprising desmocollin-2 cell adhesion recognition sequence
KAFATTPE

SEQ ID NO: 1727 - protein, 9 aa, Artificial Sequence
  Cyclicized modulating agent comprising desmocollin-2 cell adhesion recognition sequence
KAFATTPDE

SEQ ID NO: 1728 - protein, 10 aa, Artificial Sequence
  Cyclicized modulating agent comprising desmocollin-2 cell adhesion recognition sequence
KAFATTPDGE

SEQ ID NO: 1729 - protein, 7 aa, Artificial Sequence
  Cyclicized modulating agent comprising desmocollin-2 cell adhesion recognition sequence
KIAFATE

SEQ ID NO: 1730 - protein, 8 aa, Artificial Sequence
  Cyclicized modulating agent comprising desmocollin-2 cell adhesion recognition sequence
KIAFATTE

SEQ ID NO: 1731 - protein, 9 aa, Artificial Sequence
  Cyclicized modulating agent comprising desmocollin-2 cell adhesion recognition sequence
KIAFATTPE

SEQ ID NO: 1732 - protein, 10 aa, Artificial Sequence
  Cyclicized modulating agent comprising desmocollin-2 cell adhesion recognition sequence
KIAFATTPDE

SEQ ID NO: 1733 - protein, 11 aa, Artificial Sequence
  Cyclicized modulating agent comprising desmocollin-2 cell adhesion recognition sequence
KIAFATTPDGE

SEQ ID NO: 1734 - protein, 8 aa, Artificial Sequence
  Cyclicized modulating agent comprising desmocollin-2 cell adhesion recognition sequence
KIIAFATE

SEQ ID NO: 1735 - protein, 9 aa, Artificial Sequence
  Cyclicized modulating agent comprising desmocollin-2 cell adhesion recognition sequence
KIIAFATTE

SEQ ID NO: 1736 - protein, 10 aa, Artificial Sequence
  Cyclicized modulating agent comprising desmocollin-2 cell adhesion recognition sequence
KIIAFATTPE

SEQ ID NO: 1737 - protein, 11 aa, Artificial Sequence
  Cyclicized modulating agent comprising desmocollin-2 cell adhesion recognition sequence
KIIAFATTPDE

SEQ ID NO: 1738 - protein, 12 aa, Artificial Sequence
  Cyclicized modulating agent comprising desmocollin-2 cell adhesion recognition sequence
KIIAFATTPDGE

SEQ ID NO: 1739 - protein, 8 aa, Artificial Sequence
  Cyclicized modulating agent comprising desmocollin-2 cell adhesion recognition sequence
KLIAFATE

SEQ ID NO: 1740 - protein, 9 aa, Artificial Sequence
  Cyclicized modulating agent comprising desmocollin-2 cell adhesion recognition sequence
KLIAFATTE

SEQ ID NO: 1741 - protein, 10 aa, Artificial Sequence
  Cyclicized modulating agent comprising desmocollin-2 cell adhesion recognition sequence
KLIAFATTPE

SEQ ID NO: 1742 - protein, 11 aa, Artificial Sequence
  Cyclicized modulating agent comprising desmocollin-2 cell adhesion recognition sequence
KLIAFATTPDE

SEQ ID NO: 1743 - protein, 12 aa, Artificial Sequence
  Cyclicized modulating agent comprising desmocollin-2 cell adhesion recognition sequence
KLIAFATTPDGE

SEQ ID NO: 1744 - protein, 5 aa, Artificial Sequence
  Cyclicized modulating agent comprising desmocollin-2 cell adhesion recognition sequence
DFATK

SEQ ID NO: 1745 - protein, 6 aa, Artificial Sequence
  Cyclicized modulating agent comprising desmocollin-2 cell adhesion recognition sequence
DFATTK

SEQ ID NO: 1746 - protein, 7 aa, Artificial Sequence
  Cyclicized modulating agent comprising desmocollin-2 cell adhesion recognition sequence
DFATTPK

SEQ ID NO: 1747 - protein, 8 aa, Artificial Sequence
  Cyclicized modulating agent comprising desmocollin-2 cell adhesion recognition sequence
DFATTPDK

SEQ ID NO: 1748 - protein, 9 aa, Artificial Sequence
  Cyclicized modulating agent comprising desmocollin-2 cell adhesion recognition sequence
DFATTPDGK

SEQ ID NO: 1749 - protein, 6 aa, Artificial Sequence
  Cyclicized modulating agent comprising desmocollin-2 cell adhesion recognition sequence
DAFATK

SEQ ID NO: 1750 - protein, 7 aa, Artificial Sequence
  Cyclicized modulating agent comprising desmocollin-2 cell adhesion recognition sequence
DAFATTK

SEQ ID NO: 1751 - protein, 8 aa, Artificial Sequence
  Cyclicized modulating agent comprising desmocollin-2 cell adhesion recognition sequence
DAFATTPK

SEQ ID NO: 1752 - protein, 9 aa, Artificial Sequence
  Cyclicized modulating agent comprising desmocollin-2 cell adhesion recognition sequence
DAFATTPDK

SEQ ID NO: 1753 - protein, 10 aa, Artificial Sequence
  Cyclicized modulating agent comprising desmocollin-2 cell adhesion recognition sequence
DAFATTPDGK

SEQ ID NO: 1754 - protein, 7 aa, Artificial Sequence
  Cyclicized modulating agent comprising desmocollin-2 cell adhesion recognition sequence
DIAFATK

SEQ ID NO: 1755 - protein, 8 aa, Artificial Sequence
  Cyclicized modulating agent comprising desmocollin-2 cell adhesion recognition sequence
DIAFATTK

SEQ ID NO: 1756 - protein, 9 aa, Artificial Sequence
  Cyclicized modulating agent comprising desmocollin-2 cell adhesion recognition sequence
DIAFATTPK

SEQ ID NO: 1757 - protein, 10 aa, Artificial Sequence
  Cyclicized modulating agent comprising desmocollin-2 cell adhesion recognition sequence
DIAFATTPDK

SEQ ID NO: 1758 - protein, 11 aa, Artificial Sequence
  Cyclicized modulating agent comprising desmocollin-2 cell adhesion recognition sequence
DIAFATTPDGK

SEQ ID NO: 1759 - protein, 8 aa, Artificial Sequence
  Cyclicized modulating agent comprising desmocollin-2 cell adhesion recognition sequence
DIIAFATK

SEQ ID NO: 1760 - protein, 9 aa, Artificial Sequence
  Cyclicized modulating agent comprising desmocollin-2 cell adhesion recognition sequence
DIIAFATTK

SEQ ID NO: 1761 - protein, 10 aa, Artificial Sequence
  Cyclicized modulating agent comprising desmocollin-2 cell adhesion recognition sequence
DIIAFATTPK

SEQ ID NO: 1762 - protein, 11 aa, Artificial Sequence
  Cyclicized modulating agent comprising desmocollin-2 cell adhesion recognition sequence
DIIAFATTPDK

SEQ ID NO: 1763 - protein, 12 aa, Artificial Sequence
  Cyclicized modulating agent comprising desmocollin-2 cell adhesion recognition sequence
DIIAFATTPDGK

SEQ ID NO: 1764 - protein, 8 aa, Artificial Sequence
  Cyclicized modulating agent comprising desmocollin-2 cell adhesion recognition sequence
DLIAFATK

SEQ ID NO: 1765 - protein, 9 aa, Artificial Sequence
  Cyclicized modulating agent comprising desmocollin-2 cell adhesion recognition sequence
DLIAFATTK

SEQ ID NO: 1766 - protein, 10 aa, Artificial Sequence
  Cyclicized modulating agent comprising desmocollin-2 cell adhesion recognition sequence
DLIAFATTPK

SEQ ID NO: 1767 - protein, 11 aa, Artificial Sequence
  Cyclicized modulating agent comprising desmocollin-2 cell adhesion recognition sequence
DLIAFATTPDK

SEQ ID NO: 1768 - protein, 12 aa, Artificial Sequence
  Cyclicized modulating agent comprising desmocollin-2 cell adhesion recognition sequence
DLIAFATTPDGK

SEQ ID NO: 1769 - protein, 5 aa, Artificial Sequence
  Cyclicized modulating agent comprising desmocollin-2 cell adhesion recognition sequence
KFATD

SEQ ID NO: 1770 - protein, 6 aa, Artificial Sequence
  Cyclicized modulating agent comprising desmocollin-2 cell adhesion recognition sequence
KFATTD

SEQ ID NO: 1771 - protein, 7 aa, Artificial Sequence
  Cyclicized modulating agent comprising desmocollin-2 cell adhesion recognition sequence
KFATTPD

SEQ ID NO: 1772 - protein, 8 aa, Artificial Sequence
  Cyclicized modulating agent comprising desmocollin-2 cell adhesion recognition sequence
KFATTPDD

SEQ ID NO: 1773 - protein, 9 aa, Artificial Sequence
  Cyclicized modulating agent comprising desmocollin-2 cell adhesion recognition sequence
KFATTPDGD

SEQ ID NO: 1774 - protein, 6 aa, Artificial Sequence
  Cyclicized modulating agent comprising desmocollin-2 cell adhesion recognition sequence
KAFATD

SEQ ID NO: 1775 - protein, 7 aa, Artificial Sequence
  Cyclicized modulating agent comprising desmocollin-2 cell adhesion recognition sequence
KAFATTD

SEQ ID NO: 1776 - protein, 8 aa, Artificial Sequence
  Cyclicized modulating agent comprising desmocollin-2 cell adhesion recognition sequence
KAFATTPD

SEQ ID NO: 1777 - protein, 9 aa, Artificial Sequence
  Cyclicized modulating agent comprising desmocollin-2 cell adhesion recognition sequence
KAFATTPDD

SEQ ID NO: 1778 - protein, 10 aa, Artificial Sequence
  Cyclicized modulating agent comprising desmocollin-2 cell adhesion recognition sequence
KAFATTPDGD

SEQ ID NO: 1779 - protein, 7 aa, Artificial Sequence
  Cyclicized modulating agent comprising desmocollin-2 cell adhesion recognition sequence
KIAFATD

SEQ ID NO: 1780 - protein, 8 aa, Artificial Sequence
  Cyclicized modulating agent comprising desmocollin-2 cell adhesion recognition sequence
KIAFATTD

SEQ ID NO: 1781 - protein, 9 aa, Artificial Sequence
  Cyclicized modulating agent comprising desmocollin-2 cell adhesion recognition sequence
KIAFATTPD

SEQ ID NO: 1782 - protein, 10 aa, Artificial Sequence
  Cyclicized modulating agent comprising desmocollin-2 cell adhesion recognition sequence
KIAFATTPDD

SEQ ID NO: 1783 - protein, 11 aa, Artificial Sequence
  Cyclicized modulating agent comprising desmocollin-2 cell adhesion recognition sequence
KIAFATTPDGD

SEQ ID NO: 1784 - protein, 8 aa, Artificial Sequence
  Cyclicized modulating agent comprising desmocollin-2 cell adhesion recognition sequence
KIIAFATD

SEQ ID NO: 1785 - protein, 9 aa, Artificial Sequence
  Cyclicized modulating agent comprising desmocollin-2 cell adhesion recognition sequence
KIIAFATTD

SEQ ID NO: 1786 - protein, 10 aa, Artificial Sequence
  Cyclicized modulating agent comprising desmocollin-2 cell adhesion recognition sequence
KIIAFATTPD

SEQ ID NO: 1787 - protein, 11 aa, Artificial Sequence
  Cyclicized modulating agent comprising desmocollin-2 cell adhesion recognition sequence
KIIAFATTPDD

SEQ ID NO: 1788 - protein, 12 aa, Artificial Sequence
  Cyclicized modulating agent comprising desmocollin-2 cell adhesion recognition sequence
KIIAFATTPDGD

SEQ ID NO: 1789 - protein, 8 aa, Artificial Sequence
  Cyclicized modulating agent comprising desmocollin-2 cell adhesion recognition sequence
KLIAFATD

SEQ ID NO: 1790 - protein, 9 aa, Artificial Sequence
  Cyclicized modulating agent comprising desmocollin-2 cell adhesion recognition sequence
KLIAFATTD

SEQ ID NO: 1791 - protein, 10 aa, Artificial Sequence
  Cyclicized modulating agent comprising desmocollin-2 cell adhesion recognition sequence
KLIAFATTPD

SEQ ID NO: 1792 - protein, 11 aa, Artificial Sequence
  Cyclicized modulating agent comprising desmocollin-2 cell adhesion recognition sequence
KLIAFATTPDD

SEQ ID NO: 1793 - protein, 12 aa, Artificial Sequence
  Cyclicized modulating agent comprising desmocollin-2 cell adhesion recognition sequence
KLIAFATTPDGD

SEQ ID NO: 1794 - protein, 5 aa, Artificial Sequence
  Cyclicized modulating agent comprising desmocollin-2 cell adhesion recognition sequence
FATTP

SEQ ID NO: 1795 - protein, 6 aa, Artificial Sequence
  Cyclicized modulating agent comprising desmocollin-2 cell adhesion recognition sequence
FATTPD

SEQ ID NO: 1796 - protein, 7 aa, Artificial Sequence
  Cyclicized modulating agent comprising desmocollin-2 cell adhesion recognition sequence
FATTPDG

SEQ ID NO: 1797 - protein, 5 aa, Artificial Sequence
  Cyclicized modulating agent comprising desmocollin-2 cell adhesion recognition sequence
AFATT

SEQ ID NO: 1798 - protein, 6 aa, Artificial Sequence
  Cyclicized modulating agent comprising desmocollin-2 cell adhesion recognition sequence
AFATTP

SEQ ID NO: 1799 - protein, 7 aa, Artificial Sequence
  Cyclicized modulating agent comprising desmocollin-2 cell adhesion recognition sequence
AFATTPD

SEQ ID NO: 1800 - protein, 8 aa, Artificial Sequence
  Cyclicized modulating agent comprising desmocollin-2 cell adhesion recognition sequence
AFATTPDG

SEQ ID NO: 1801 - protein, 5 aa, Artificial Sequence
  Cyclicized modulating agent comprising desmocollin-2 cell adhesion recognition sequence
IAFAT

SEQ ID NO: 1802 - protein, 6 aa, Artificial Sequence
  Cyclicized modulating agent comprising desmocollin-2 cell adhesion recognition sequence
IAFATT

SEQ ID NO: 1803 - protein, 7 aa, Artificial Sequence
  Cyclicized modulating agent comprising desmocollin-2 cell adhesion recognition sequence
IAFATTP

SEQ ID NO: 1804 - protein, 8 aa, Artificial Sequence
  Cyclicized modulating agent comprising desmocollin-2 cell adhesion recognition sequence
IAFATTPD

SEQ ID NO: 1805 - protein, 9 aa, Artificial Sequence
  Cyclicized modulating agent comprising desmocollin-2 cell adhesion recognition sequence
IAFATTPDG

SEQ ID NO: 1806 - protein, 6 aa, Artificial Sequence
  Cyclicized modulating agent comprising desmocollin-2 cell adhesion recognition sequence
IIAFAT

SEQ ID NO: 1807 - protein, 7 aa, Artificial Sequence
  Cyclicized modulating agent comprising desmocollin-2 cell adhesion recognition sequence
IIAFATT

SEQ ID NO: 1808 - protein, 8 aa, Artificial Sequence
  Cyclicized modulating agent comprising desmocollin-2 cell adhesion recognition sequence
IIAFATTP

SEQ ID NO: 1809 - protein, 9 aa, Artificial Sequence
  Cyclicized modulating agent comprising desmocollin-2 cell adhesion recognition sequence
IIAFATTPD

SEQ ID NO: 1810 - protein, 10 aa, Artificial Sequence
  Cyclicized modulating agent comprising desmocollin-2 cell adhesion recognition sequence
IIAFATTPDG

SEQ ID NO: 1811 - protein, 6 aa, Artificial Sequence
  Cyclicized modulating agent comprising desmocollin-2 cell adhesion recognition sequence
LIAFAT

SEQ ID NO: 1812 - protein, 7 aa, Artificial Sequence
  Cyclicized modulating agent comprising desmocollin-2 cell adhesion recognition sequence
LIAFATT

SEQ ID NO: 1813 - protein, 8 aa, Artificial Sequence
  Cyclicized modulating agent comprising desmocollin-2 cell adhesion recognition sequence
LIAFATTP

SEQ ID NO: 1814 - protein, 9 aa, Artificial Sequence
  Cyclicized modulating agent comprising desmocollin-2 cell adhesion recognition sequence
LIAFATTPD

SEQ ID NO: 1815 - protein, 10 aa, Artificial Sequence
  Cyclicized modulating agent comprising desmocollin-2 cell adhesion recognition sequence
LIAFATTPDG

SEQ ID NO: 1816 - protein, 5 aa, Artificial Sequence
  Cyclicized modulating agent comprising desmocollin-3 or desmocollin-4 cell adhesion recognition sequence
CYASC

SEQ ID NO: 1817 - protein, 6 aa, Artificial Sequence
  Cyclicized modulating agent comprising desmocollin-3 or desmocollin-4 cell adhesion recognition sequence
CYASTC

SEQ ID NO: 1818 - protein, 7 aa, Artificial Sequence
  Cyclicized modulating agent comprising desmocollin-3 or desmocollin-4 cell adhesion recognition sequence
CYASTAC

SEQ ID NO: 1819 - protein, 8 aa, Artificial Sequence
  Cyclicized modulating agent comprising desmocollin-3 or desmocollin-4 cell adhesion recognition sequence
CYASTADC

SEQ ID NO: 1820 - protein, 9 aa, Artificial Sequence
  Cyclicized modulating agent comprising desmocollin-3 or desmocollin-4 cell adhesion recognition sequence
CYASTADGC

SEQ ID NO: 1821 - protein, 6 aa, Artificial Sequence
  Cyclicized modulating agent comprising desmocollin-3 or desmocollin-4 cell adhesion recognition sequence
CAYASC

SEQ ID NO: 1822 - protein, 7 aa, Artificial Sequence
  Cyclicized modulating agent comprising desmocollin-3 or desmocollin-4 cell adhesion recognition sequence
CAYASTC

SEQ ID NO: 1823 - protein, 8 aa, Artificial Sequence
  Cyclicized modulating agent comprising desmocollin-3 or desmocollin-4 cell adhesion recognition sequence
CAYASTAC

SEQ ID NO: 1824 - protein, 9 aa, Artificial Sequence
  Cyclicized modulating agent comprising desmocollin-3 or desmocollin-4 cell adhesion recognition sequence
CAYASTADC

SEQ ID NO: 1825 - protein, 10 aa, Artificial Sequence
  Cyclicized modulating agent comprising desmocollin-3 or desmocollin-4 cell adhesion recognition sequence
CAYASTADGC

SEQ ID NO: 1826 - protein, 7 aa, Artificial Sequence
  Cyclicized modulating agent comprising desmocollin-3 or desmocollin-4 cell adhesion recognition sequence
CIAYASC

SEQ ID NO: 1827 - protein, 8 aa, Artificial Sequence
  Cyclicized modulating agent comprising desmocollin-3 or desmocollin-4 cell adhesion recognition sequence
CIAYASTC

SEQ ID NO: 1828 - protein, 9 aa, Artificial Sequence
  Cyclicized modulating agent comprising desmocollin-3 or desmocollin-4 cell adhesion recognition sequence
CIAYASTAC

SEQ ID NO: 1829 - protein, 10 aa, Artificial Sequence
  Cyclicized modulating agent comprising desmocollin-3 or desmocollin-4 cell adhesion recognition sequence
CIAYASTADC

SEQ ID NO: 1830 - protein, 11 aa, Artificial Sequence
  Cyclicized modulating agent comprising desmocollin-3 or desmocollin-4 cell adhesion recognition sequence
CIAYASTADGC

SEQ ID NO: 1831 - protein, 8 aa, Artificial Sequence
  Cyclicized modulating agent comprising desmocollin-3 or desmocollin-4 cell adhesion recognition sequence
CLIAYASC

SEQ ID NO: 1832 - protein, 9 aa, Artificial Sequence
  Cyclicized modulating agent comprising desmocollin-3 or desmocollin-4 cell adhesion recognition sequence
CLIAYASTC

SEQ ID NO: 1833 - protein, 10 aa, Artificial Sequence
  Cyclicized modulating agent comprising desmocollin-3 or desmocollin-4 cell adhesion recognition sequence
CLIAYASTAC

SEQ ID NO: 1834 - protein, 11 aa, Artificial Sequence
  Cyclicized modulating agent comprising desmocollin-3 or desmocollin-4 cell adhesion recognition sequence
CLIAYASTADC

SEQ ID NO: 1835 - protein, 12 aa, Artificial Sequence
  Cyclicized modulating agent comprising desmocollin-3 or desmocollin-4 cell adhesion recognition sequence
CLIAYASTADGC

SEQ ID NO: 1836 - protein, 5 aa, Artificial Sequence
  Cyclicized modulating agent comprising desmocollin-3 or desmocollin-4 cell adhesion recognition sequence
EYASK

SEQ ID NO: 1837 - protein, 6 aa, Artificial Sequence
  Cyclicized modulating agent comprising desmocollin-3 or desmocollin-4 cell adhesion recognition sequence
EYASTK

SEQ ID NO: 1838 - protein, 7 aa, Artificial Sequence
  Cyclicized modulating agent comprising desmocollin-3 or desmocollin-4 cell adhesion recognition sequence
EYASTAK

SEQ ID NO: 1839 - protein, 8 aa, Artificial Sequence
  Cyclicized modulating agent comprising desmocollin-3 or desmocollin-4 cell adhesion recognition sequence
EYASTADK

SEQ ID NO: 1840 - protein, 9 aa, Artificial Sequence
  Cyclicized modulating agent comprising desmocollin-3 or desmocollin-4 cell adhesion recognition sequence
EYASTADGK

SEQ ID NO: 1841 - protein, 6 aa, Artificial Sequence
  Cyclicized modulating agent comprising desmocollin-3 or desmocollin-4 cell adhesion recognition sequence
EAYASK

SEQ ID NO: 1842 - protein, 7 aa, Artificial Sequence
  Cyclicized modulating agent comprising desmocollin-3 or desmocollin-4 cell adhesion recognition sequence
EAYASTK

SEQ ID NO: 1843 - protein, 8 aa, Artificial Sequence
  Cyclicized modulating agent comprising desmocollin-3 or desmocollin-4 cell adhesion recognition sequence
EAYASTAK

SEQ ID NO: 1844 - protein, 9 aa, Artificial Sequence
  Cyclicized modulating agent comprising desmocollin-3 or desmocollin-4 cell adhesion recognition sequence
EAYASTADK

SEQ ID NO: 1845 - protein, 10 aa, Artificial Sequence
  Cyclicized modulating agent comprising desmocollin-3 or desmocollin-4 cell adhesion recognition sequence
EAYASTADGK

SEQ ID NO: 1846 - protein, 7 aa, Artificial Sequence
  Cyclicized modulating agent comprising desmocollin-3 or desmocollin-4 cell adhesion recognition sequence
EIAYASK

SEQ ID NO: 1847 - protein, 8 aa, Artificial Sequence
  Cyclicized modulating agent comprising desmocollin-3 or desmocollin-4 cell adhesion recognition sequence
EIAYASTK

SEQ ID NO: 1848 - protein, 9 aa, Artificial Sequence
  Cyclicized modulating agent comprising desmocollin-3 or desmocollin-4 cell adhesion recognition sequence
EIAYASTAK

SEQ ID NO: 1849 - protein, 10 aa, Artificial Sequence
  Cyclicized modulating agent comprising desmocollin-3 or desmocollin-4 cell adhesion recognition sequence
EIAYASTADK

SEQ ID NO: 1850 - protein, 11 aa, Artificial Sequence
  Cyclicized modulating agent comprising desmocollin-3 or desmocollin-4 cell adhesion recognition sequence
EIAYASTADGK

SEQ ID NO: 1851 - protein, 8 aa, Artificial Sequence
  Cyclicized modulating agent comprising desmocollin-3 or desmocollin-4 cell adhesion recognition sequence
ELIAYASK

SEQ ID NO: 1852 - protein, 9 aa, Artificial Sequence
  Cyclicized modulating agent comprising desmocollin-3 or desmocollin-4 cell adhesion recognition sequence
ELIAYASTK

SEQ ID NO: 1853 - protein, 10 aa, Artificial Sequence
  Cyclicized modulating agent comprising desmocollin-3 or desmocollin-4 cell adhesion recognition sequence
ELIAYASTAK

SEQ ID NO: 1854 - protein, 11 aa, Artificial Sequence
  Cyclicized modulating agent comprising desmocollin-3 or desmocollin-4 cell adhesion recognition sequence
ELIAYASTADK

SEQ ID NO: 1855 - protein, 12 aa, Artificial Sequence
  Cyclicized modulating agent comprising desmocollin-3 or desmocollin-4 cell adhesion recognition sequence
ELIAYASTADGK

SEQ ID NO: 1856 - protein, 5 aa, Artificial Sequence
  Cyclicized modulating agent comprising desmocollin-3 or desmocollin-4 cell adhesion recognition sequence
KYASE

SEQ ID NO: 1857 - protein, 6 aa, Artificial Sequence
  Cyclicized modulating agent comprising desmocollin-3 or desmocollin-4 cell adhesion recognition sequence
KYASTE

SEQ ID NO: 1858 - protein, 7 aa, Artificial Sequence
  Cyclicized modulating agent comprising desmocollin-3 or desmocollin-4 cell adhesion recognition sequence
KYASTAE

SEQ ID NO: 1859 - protein, 8 aa, Artificial Sequence
  Cyclicized modulating agent comprising desmocollin-3 or desmocollin-4 cell adhesion recognition sequence
KYASTADE

SEQ ID NO: 1860 - protein, 9 aa, Artificial Sequence
  Cyclicized modulating agent comprising desmocollin-3 or desmocollin-4 cell adhesion recognition sequence
KYASTADGE

SEQ ID NO: 1861 - protein, 6 aa, Artificial Sequence
  Cyclicized modulating agent comprising desmocollin-3 or desmocollin-4 cell adhesion recognition sequence
KAYASE

SEQ ID NO: 1862 - protein, 7 aa, Artificial Sequence
  Cyclicized modulating agent comprising desmocollin-3 or desmocollin-4 cell adhesion recognition sequence
KAYASTE

SEQ ID NO: 1863 - protein, 8 aa, Artificial Sequence
  Cyclicized modulating agent comprising desmocollin-3 or desmocollin-4 cell adhesion recognition sequence
KAYASTAE

SEQ ID NO: 1864 - protein, 9 aa, Artificial Sequence
  Cyclicized modulating agent comprising desmocollin-3 or desmocollin-4 cell adhesion recognition sequence
KAYASTADE

SEQ ID NO: 1865 - protein, 10 aa, Artificial Sequence
  Cyclicized modulating agent comprising desmocollin-3 or desmocollin-4 cell adhesion recognition sequence
KAYASTADGE

SEQ ID NO: 1866 - protein, 7 aa, Artificial Sequence
  Cyclicized modulating agent comprising desmocollin-3 or desmocollin-4 cell adhesion recognition sequence
KIAYASE

SEQ ID NO: 1867 - protein, 8 aa, Artificial Sequence
  Cyclicized modulating agent comprising desmocollin-3 or desmocollin-4 cell adhesion recognition sequence
KIAYASTE

SEQ ID NO: 1868 - protein, 9 aa, Artificial Sequence
  Cyclicized modulating agent comprising desmocollin-3 or desmocollin-4 cell adhesion recognition sequence
KIAYASTAE

SEQ ID NO: 1869 - protein, 10 aa, Artificial Sequence
  Cyclicized modulating agent comprising desmocollin-3 or desmocollin-4 cell adhesion recognition sequence
KIAYASTADE

SEQ ID NO: 1870 - protein, 11 aa, Artificial Sequence
  Cyclicized modulating agent comprising desmocollin-3 or desmocollin-4 cell adhesion recognition sequence
KIAYASTADGE

SEQ ID NO: 1871 - protein, 8 aa, Artificial Sequence
  Cyclicized modulating agent comprising desmocollin-3 or desmocollin-4 cell adhesion recognition sequence
KLIAYASE

SEQ ID NO: 1872 - protein, 9 aa, Artificial Sequence
  Cyclicized modulating agent comprising desmocollin-3 or desmocollin-4 cell adhesion recognition sequence
KLIAYASTE

SEQ ID NO: 1873 - protein, 10 aa, Artificial Sequence
  Cyclicized modulating agent comprising desmocollin-3 or desmocollin-4 cell adhesion recognition sequence
KLIAYASTAE

SEQ ID NO: 1874 - protein, 11 aa, Artificial Sequence
  Cyclicized modulating agent comprising desmocollin-3 or desmocollin-4 cell adhesion recognition sequence
KLIAYASTADE

SEQ ID NO: 1875 - protein, 12 aa, Artificial Sequence
  Cyclicized modulating agent comprising desmocollin-3 or desmocollin-4 cell adhesion recognition sequence
KLIAYASTADGE

SEQ ID NO: 1876 - protein, 5 aa, Artificial Sequence
  Cyclicized modulating agent comprising desmocollin-3 or desmocollin-4 cell adhesion recognition sequence
DYASK

SEQ ID NO: 1877 - protein, 6 aa, Artificial Sequence
  Cyclicized modulating agent comprising desmocollin-3 or desmocollin-4 cell adhesion recognition sequence
DYASTK

SEQ ID NO: 1878 - protein, 7 aa, Artificial Sequence
  Cyclicized modulating agent comprising desmocollin-3 or desmocollin-4 cell adhesion recognition sequence
DYASTAK

SEQ ID NO: 1879 - protein, 8 aa, Artificial Sequence
  Cyclicized modulating agent comprising desmocollin-3 or desmocollin-4 cell adhesion recognition sequence
DYASTADK

SEQ ID NO: 1880 - protein, 9 aa, Artificial Sequence
  Cyclicized modulating agent comprising desmocollin-3 or desmocollin-4 cell adhesion recognition sequence
DYASTADGK

SEQ ID NO: 1881 - protein, 6 aa, Artificial Sequence
  Cyclicized modulating agent comprising desmocollin-3 or desmocollin-4 cell adhesion recognition sequence
DAYASK

SEQ ID NO: 1882 - protein, 7 aa, Artificial Sequence
  Cyclicized modulating agent comprising desmocollin-3 or desmocollin-4 cell adhesion recognition sequence
DAYASTK

SEQ ID NO: 1883 - protein, 8 aa, Artificial Sequence
  Cyclicized modulating agent comprising desmocollin-3 or desmocollin-4 cell adhesion recognition sequence
DAYASTAK

SEQ ID NO: 1884 - protein, 9 aa, Artificial Sequence
  Cyclicized modulating agent comprising desmocollin-3 or desmocollin-4 cell adhesion recognition sequence
DAYASTADK

SEQ ID NO: 1885 - protein, 10 aa, Artificial Sequence
  Cyclicized modulating agent comprising desmocollin-3 or desmocollin-4 cell adhesion recognition sequence
DAYASTADGK

SEQ ID NO: 1886 - protein, 7 aa, Artificial Sequence
  Cyclicized modulating agent comprising desmocollin-3 or desmocollin-4 cell adhesion recognition sequence
DIAYASK

SEQ ID NO: 1887 - protein, 8 aa, Artificial Sequence
  Cyclicized modulating agent comprising desmocollin-3 or desmocollin-4 cell adhesion recognition sequence
DIAYASTK

SEQ ID NO: 1888 - protein, 9 aa, Artificial Sequence
  Cyclicized modulating agent comprising desmocollin-3 or desmocollin-4 cell adhesion recognition sequence
DIAYASTAK

SEQ ID NO: 1889 - protein, 10 aa, Artificial Sequence
  Cyclicized modulating agent comprising desmocollin-3 or desmocollin-4 cell adhesion recognition sequence
DIAYASTADK

SEQ ID NO: 1890 - protein, 11 aa, Artificial Sequence
  Cyclicized modulating agent comprising desmocollin-3 or desmocollin-4 cell adhesion recognition sequence
DIAYASTADGK

SEQ ID NO: 1891 - protein, 8 aa, Artificial Sequence
  Cyclicized modulating agent comprising desmocollin-3 or desmocollin-4 cell adhesion recognition sequence
DLIAYASK

SEQ ID NO: 1892 - protein, 9 aa, Artificial Sequence
  Cyclicized modulating agent comprising desmocollin-3 or desmocollin-4 cell adhesion recognition sequence
DLIAYASTK

SEQ ID NO: 1893 - protein, 10 aa, Artificial Sequence
  Cyclicized modulating agent comprising desmocollin-3 or desmocollin-4 cell adhesion recognition sequence
DLIAYASTAK

SEQ ID NO: 1894 - protein, 11 aa, Artificial Sequence
  Cyclicized modulating agent comprising desmocollin-3 or desmocollin-4 cell adhesion recognition sequence
DLIAYASTADK

SEQ ID NO: 1895 - protein, 12 aa, Artificial Sequence
  Cyclicized modulating agent comprising desmocollin-3 or desmocollin-4 cell adhesion recognition sequence
DLIAYASTADGK

SEQ ID NO: 1896 - protein, 5 aa, Artificial Sequence
  Cyclicized modulating agent comprising desmocollin-3 or desmocollin-4 cell adhesion recognition sequence
KYASD

SEQ ID NO: 1897 - protein, 6 aa, Artificial Sequence
  Cyclicized modulating agent comprising desmocollin-3 or desmocollin-4 cell adhesion recognition sequence
KYASTD

SEQ ID NO: 1898 - protein, 7 aa, Artificial Sequence
  Cyclicized modulating agent comprising desmocollin-3 or desmocollin-4 cell adhesion recognition sequence
KYASTAD

SEQ ID NO: 1899 - protein, 8 aa, Artificial Sequence
  Cyclicized modulating agent comprising desmocollin-3 or desmocollin-4 cell adhesion recognition sequence
KYASTADD

SEQ ID NO: 1900 - protein, 9 aa, Artificial Sequence
  Cyclicized modulating agent comprising desmocollin-3 or desmocollin-4 cell adhesion recognition sequence
KYASTADGD

SEQ ID NO: 1901 - protein, 6 aa, Artificial Sequence
  Cyclicized modulating agent comprising desmocollin-3 or desmocollin-4 cell adhesion recognition sequence
KAYASD

SEQ ID NO: 1902 - protein, 7 aa, Artificial Sequence
  Cyclicized modulating agent comprising desmocollin-3 or desmocollin-4 cell adhesion recognition sequence
KAYASTD

SEQ ID NO: 1903 - protein, 8 aa, Artificial Sequence
  Cyclicized modulating agent comprising desmocollin-3 or desmocollin-4 cell adhesion recognition sequence
KAYASTAD

SEQ ID NO: 1904 - protein, 9 aa, Artificial Sequence
  Cyclicized modulating agent comprising desmocollin-3 or desmocollin-4 cell adhesion recognition sequence
KAYASTADD

SEQ ID NO: 1905 - protein, 10 aa, Artificial Sequence
  Cyclicized modulating agent comprising desmocollin-3 or desmocollin-4 cell adhesion recognition sequence
KAYASTADGD

SEQ ID NO: 1906 - protein, 7 aa, Artificial Sequence
  Cyclicized modulating agent comprising desmocollin-3 or desmocollin-4 cell adhesion recognition sequence
KIAYASD

SEQ ID NO: 1907 - protein, 8 aa, Artificial Sequence
  Cyclicized modulating agent comprising desmocollin-3 or desmocollin-4 cell adhesion recognition sequence
KIAYASTD

SEQ ID NO: 1908 - protein, 9 aa, Artificial Sequence
  Cyclicized modulating agent comprising desmocollin-3 or desmocollin-4 cell adhesion recognition sequence
KIAYASTAD

SEQ ID NO: 1909 - protein, 10 aa, Artificial Sequence
  Cyclicized modulating agent comprising desmocollin-3 or desmocollin-4 cell adhesion recognition sequence
KIAYASTADD

SEQ ID NO: 1910 - protein, 11 aa, Artificial Sequence
  Cyclicized modulating agent comprising desmocollin-3 or desmocollin-4 cell adhesion recognition sequence
KIAYASTADGD

SEQ ID NO: 1911 - protein, 8 aa, Artificial Sequence
  Cyclicized modulating agent comprising desmocollin-3 or desmocollin-4 cell adhesion recognition sequence
KLIAYASD

SEQ ID NO: 1912 - protein, 9 aa, Artificial Sequence
  Cyclicized modulating agent comprising desmocollin-3 or desmocollin-4 cell adhesion recognition sequence
KLIAYASTD

SEQ ID NO: 1913 - protein, 10 aa, Artificial Sequence
  Cyclicized modulating agent comprising desmocollin-3 or desmocollin-4 cell adhesion recognition sequence
KLIAYASTAD

SEQ ID NO: 1914 - protein, 11 aa, Artificial Sequence
  Cyclicized modulating agent comprising desmocollin-3 or desmocollin-4 cell adhesion recognition sequence
KLIAYASTADD

SEQ ID NO: 1915 - protein, 12 aa, Artificial Sequence
  Cyclicized modulating agent comprising desmocollin-3 or desmocollin-4 cell adhesion recognition sequence
KLIAYASTADGD

SEQ ID NO: 1916 - protein, 5 aa, Artificial Sequence
  Cyclicized modulating agent comprising desmocollin-3 or desmocollin-4 cell adhesion recognition sequence
YASTA

SEQ ID NO: 1917 - protein, 6 aa, Artificial Sequence
  Cyclicized modulating agent comprising desmocollin-3 or desmocollin-4 cell adhesion recognition sequence
YASTAD

SEQ ID NO: 1918 - protein, 7 aa, Artificial Sequence
  Cyclicized modulating agent comprising desmocollin-3 or desmocollin-4 cell adhesion recognition sequence
YASTADG

SEQ ID NO: 1919 - protein, 5 aa, Artificial Sequence
  Cyclicized modulating agent comprising desmocollin-3 or desmocollin-4 cell adhesion recognition sequence
AYAST

SEQ ID NO: 1920 - protein, 6 aa, Artificial Sequence
  Cyclicized modulating agent comprising desmocollin-3 or desmocollin-4 cell adhesion recognition sequence
AYASTA

SEQ ID NO: 1921 - protein, 7 aa, Artificial Sequence
  Cyclicized modulating agent comprising desmocollin-3 or desmocollin-4 cell adhesion recognition sequence
AYASTAD

SEQ ID NO: 1922 - protein, 8 aa, Artificial Sequence
  Cyclicized modulating agent comprising desmocollin-3 or desmocollin-4 cell adhesion recognition sequence
AYASTADG

SEQ ID NO: 1923 - protein, 5 aa, Artificial Sequence
  Cyclicized modulating agent comprising desmocollin-3 or desmocollin-4 cell adhesion recognition sequence
IAYAS

SEQ ID NO: 1924 - protein, 6 aa, Artificial Sequence
  Cyclicized modulating agent comprising desmocollin-3 or desmocollin-4 cell adhesion recognition sequence
IAYAST

SEQ ID NO: 1925 - protein, 7 aa, Artificial Sequence
  Cyclicized modulating agent comprising desmocollin-3 or desmocollin-4 cell adhesion recognition sequence
IAYASTA

SEQ ID NO: 1926 - protein, 8 aa, Artificial Sequence
  Cyclicized modulating agent comprising desmocollin-3 or desmocollin-4 cell adhesion recognition sequence
IAYASTAD

SEQ ID NO: 1927 - protein, 9 aa, Artificial Sequence
  Cyclicized modulating agent comprising desmocollin-3 or desmocollin-4 cell adhesion recognition sequence
IAYASTADG

SEQ ID NO: 1928 - protein, 6 aa, Artificial Sequence
  Cyclicized modulating agent comprising desmocollin-3 or desmocollin-4 cell adhesion recognition sequence
LIAYAS

SEQ ID NO: 1929 - protein, 7 aa, Artificial Sequence
  Cyclicized modulating agent comprising desmocollin-3 or desmocollin-4 cell adhesion recognition sequence
LIAYAST

SEQ ID NO: 1930 - protein, 8 aa, Artificial Sequence
  Cyclicized modulating agent comprising desmocollin-3 or desmocollin-4 cell adhesion recognition sequence
LIAYASTA

SEQ ID NO: 1931 - protein, 9 aa, Artificial Sequence
  Cyclicized modulating agent comprising desmocollin-3 or desmocollin-4 cell adhesion recognition sequence
LIAYASTAD

SEQ ID NO: 1932 - protein, 10 aa, Artificial Sequence
  Cyclicized modulating agent comprising desmocollin-3 or desmocollin-4 cell adhesion recognition sequence
LIAYASTADG

SEQ ID NO: 1933 - protein, 5 aa, Unknown
  Preferred cell adhesion recognition sequence for inclusion in modulating agent
YIGSR

SEQ ID NO: 1934 - protein, 10 aa, Unknown
  Preferred cell adhesion recognition sequence for inclusion in modulating agent
KYSFNYDGSE

SEQ ID NO: 1935 - protein, 17 aa, Unknown
  Preferred cell adhesion recognition sequence for inclusion in modulating agent
IWKHKGRDVILKKDVRF

SEQ ID NO: 1936 - protein, 4 aa, Unknown
  Preferred cell adhesion recognition sequence for inclusion in modulating agent
IYSY

SEQ ID NO: 1937 - protein, 4 aa, Unknown
  Preferred cell adhesion recognition sequence for inclusion in modulating agent
LYHY

SEQ ID NO: 1938 - protein, 4 aa, Unknown
  Preferred  OB-cadherin cell adhesion recognition sequence for inclusion within modulating agent
IDDK

SEQ ID NO: 1939 - protein, 4 aa, Unknown
  Preferred  OB-cadherin cell adhesion recognition sequence for inclusion within modulating agent
DDKS

SEQ ID NO: 1940 - protein, 5 aa, Unknown
  Preferred  OB-cadherin cell adhesion recognition sequence for inclusion within modulating agent
VIDDK

SEQ ID NO: 1941 - protein, 4 aa, Unknown
  Preferred  OB-cadherin cell adhesion recognition sequence for inclusion within modulating agent
DDKS

SEQ ID NO: 1942 - protein, 6 aa, Unknown
  Preferred  OB-cadherin cell adhesion recognition sequence for inclusion within modulating agent
VIDDKS

SEQ ID NO: 1943 - protein, 5 aa, Unknown
  Preferred  OB-cadherin cell adhesion recognition sequence for inclusion within modulating agent
DDKSG

SEQ ID NO: 1944 - protein, 6 aa, Unknown
  Preferred  OB-cadherin cell adhesion recognition sequence for inclusion within modulating agent
IDDKSG

SEQ ID NO: 1945 - protein, 7 aa, Unknown
  Preferred  OB-cadherin cell adhesion recognition sequence for inclusion within modulating agent
VIDDKSG

SEQ ID NO: 1946 - protein, 6 aa, Unknown
  Preferred  OB-cadherin cell adhesion recognition sequence for inclusion within modulating agent
FVIDDK

SEQ ID NO: 1947 - protein, 7 aa, Unknown
  Preferred  OB-cadherin cell adhesion recognition sequence for inclusion within modulating agent
FVIDDKS

SEQ ID NO: 1948 - protein, 8 aa, Unknown
  Preferred  OB-cadherin cell adhesion recognition sequence for inclusion within modulating agent
FVIDDKSG

SEQ ID NO: 1949 - protein, 7 aa, Unknown
  Preferred  OB-cadherin cell adhesion recognition sequence for inclusion within modulating agent
IFVIDDK

SEQ ID NO: 1950 - protein, 8 aa, Unknown
  Preferred  OB-cadherin cell adhesion recognition sequence for inclusion within modulating agent
IFVIDDKS

SEQ ID NO: 1951 - protein, 9 aa, Unknown
  Preferred  OB-cadherin cell adhesion recognition sequence for inclusion within modulating agent
IFVIDDKSG

SEQ ID NO: 1952 - protein, 4 aa, Unknown
  Preferred  OB-cadherin cell adhesion recognition sequence for inclusion within modulating agent
IEEY

SEQ ID NO: 1953 - protein, 4 aa, Unknown
  Preferred  OB-cadherin cell adhesion recognition sequence for inclusion within modulating agent
EEYT

SEQ ID NO: 1954 - protein, 5 aa, Unknown
  Preferred  OB-cadherin cell adhesion recognition sequence for inclusion within modulating agent
VIEEY

SEQ ID NO: 1955 - protein, 5 aa, Unknown
  Preferred  OB-cadherin cell adhesion recognition sequence for inclusion within modulating agent
IEEYT

SEQ ID NO: 1956 - protein, 6 aa, Unknown
  Preferred  OB-cadherin cell adhesion recognition sequence for inclusion within modulating agent
VIEEYT

SEQ ID NO: 1957 - protein, 5 aa, Unknown
  Preferred  OB-cadherin cell adhesion recognition sequence for inclusion within modulating agent
EEYTG

SEQ ID NO: 1958 - protein, 6 aa, Unknown
  Preferred  OB-cadherin cell adhesion recognition sequence for inclusion within modulating agent
IEEYTG

SEQ ID NO: 1959 - protein, 7 aa, Unknown
  Preferred  OB-cadherin cell adhesion recognition sequence for inclusion within modulating agent
VIEEYTG

SEQ ID NO: 1960 - protein, 6 aa, Unknown
  Preferred  OB-cadherin cell adhesion recognition sequence for inclusion within modulating agent
FVIEEY

SEQ ID NO: 1961 - protein, 7 aa, Unknown
  Preferred  OB-cadherin cell adhesion recognition sequence for inclusion within modulating agent
FVIEEYT

SEQ ID NO: 1962 - protein, 8 aa, Unknown
  Preferred  OB-cadherin cell adhesion recognition sequence for inclusion within modulating agent
FVIEEYTG

SEQ ID NO: 1963 - protein, 7 aa, Unknown
  Preferred  OB-cadherin cell adhesion recognition sequence for inclusion within modulating agent
FFVIEEY

SEQ ID NO: 1964 - protein, 8 aa, Unknown
  Preferred  OB-cadherin cell adhesion recognition sequence for inclusion within modulating agent
FFVIEEYT

SEQ ID NO: 1965 - protein, 9 aa, Unknown
  Preferred  OB-cadherin cell adhesion recognition sequence for inclusion within modulating agent
FFVIEEYTG

SEQ ID NO: 1966 - protein, 4 aa, Unknown
  Preferred  OB-cadherin cell adhesion recognition sequence for inclusion within modulating agent
VEAQ

SEQ ID NO: 1967 - protein, 4 aa, Unknown
  Preferred  OB-cadherin cell adhesion recognition sequence for inclusion within modulating agent
EAQT

SEQ ID NO: 1968 - protein, 5 aa, Unknown
  Preferred  OB-cadherin cell adhesion recognition sequence for inclusion within modulating agent
SVEAQ

SEQ ID NO: 1969 - protein, 5 aa, Unknown
  Preferred  OB-cadherin cell adhesion recognition sequence for inclusion within modulating agent
VEAQT

SEQ ID NO: 1970 - protein, 6 aa, Unknown
  Preferred  OB-cadherin cell adhesion recognition sequence for inclusion within modulating agent
SVEAQT

SEQ ID NO: 1971 - protein, 5 aa, Unknown
  Preferred  OB-cadherin cell adhesion recognition sequence for inclusion within modulating agent
EAQTG

SEQ ID NO: 1972 - protein, 6 aa, Unknown
  Preferred  OB-cadherin cell adhesion recognition sequence for inclusion within modulating agent
VEAQTG

SEQ ID NO: 1973 - protein, 7 aa, Unknown
  Preferred  OB-cadherin cell adhesion recognition sequence for inclusion within modulating agent
SVEAQTG

SEQ ID NO: 1974 - protein, 6 aa, Unknown
  Preferred  OB-cadherin cell adhesion recognition sequence for inclusion within modulating agent
FSVEAQ

SEQ ID NO: 1975 - protein, 7 aa, Unknown
  Preferred  OB-cadherin cell adhesion recognition sequence for inclusion within modulating agent
FSVEAQT

SEQ ID NO: 1976 - protein, 8 aa, Unknown
  Preferred  OB-cadherin cell adhesion recognition sequence for inclusion within modulating agent
FSVEAQTG

SEQ ID NO: 1977 - protein, 7 aa, Unknown
  Preferred  OB-cadherin cell adhesion recognition sequence for inclusion within modulating agent
YFSVEAQ

SEQ ID NO: 1978 - protein, 8 aa, Unknown
  Preferred  OB-cadherin cell adhesion recognition sequence for inclusion within modulating agent
YFSVEAQT

SEQ ID NO: 1979 - protein, 8 aa, Unknown
  Preferred  OB-cadherin cell adhesion recognition sequence for inclusion within modulating agent
FSVEAQTG

SEQ ID NO: 1980 - protein, 4 aa, Unknown
  Preferred  cadherin-5 cell adhesion recognition sequence for inclusion within modulating agent
VDAE

SEQ ID NO: 1981 - protein, 4 aa, Unknown
  Preferred  cadherin-5 cell adhesion recognition sequence for inclusion within modulating agent
DAET

SEQ ID NO: 1982 - protein, 5 aa, Unknown
  Preferred  cadherin-5 cell adhesion recognition sequence for inclusion within modulating agent
RVDAE

SEQ ID NO: 1983 - protein, 5 aa, Unknown
  Preferred  cadherin-5 cell adhesion recognition sequence for inclusion within modulating agent
VDAET

SEQ ID NO: 1984 - protein, 6 aa, Unknown
  Preferred  cadherin-5 cell adhesion recognition sequence for inclusion within modulating agent
RVDAET

SEQ ID NO: 1985 - protein, 5 aa, Unknown
  Preferred  cadherin-5 cell adhesion recognition sequence for inclusion within modulating agent
DAETG

SEQ ID NO: 1986 - protein, 6 aa, Unknown
  Preferred  cadherin-5 cell adhesion recognition sequence for inclusion within modulating agent
VDAETG

SEQ ID NO: 1987 - protein, 7 aa, Unknown
  Preferred  cadherin-5 cell adhesion recognition sequence for inclusion within modulating agent
RVDAETG

SEQ ID NO: 1988 - protein, 6 aa, Unknown
  Preferred  cadherin-5 cell adhesion recognition sequence for inclusion within modulating agent
FRVDAE

SEQ ID NO: 1989 - protein, 7 aa, Unknown
  Preferred  cadherin-5 cell adhesion recognition sequence for inclusion within modulating agent
FRVDAET

SEQ ID NO: 1990 - protein, 8 aa, Unknown
  Preferred  cadherin-5 cell adhesion recognition sequence for inclusion within modulating agent
FRVDAETG

SEQ ID NO: 1991 - protein, 7 aa, Unknown
  Preferred  cadherin-5 cell adhesion recognition sequence for inclusion within modulating agent
VFRVDAE

SEQ ID NO: 1992 - protein, 8 aa, Unknown
  Preferred  cadherin-5 cell adhesion recognition sequence for inclusion within modulating agent
VFRVDAET

SEQ ID NO: 1993 - protein, 8 aa, Artificial Sequence
  Cell adhesion recognition sequence for inclusion within modulating agent
CINQKTGC

SEQ ID NO: 1994 - protein, 6 aa, Artificial Sequence
  Cell adhesion recognition sequence for inclusion within modulating agent
CINQKC

SEQ ID NO: 1995 - protein, 6 aa, Artificial Sequence
  Cell adhesion recognition sequence for inclusion within cyclic modulating agent
CNQKTC

SEQ ID NO: 1996 - protein, 7 aa, Artificial Sequence
  Cell adhesion recognition sequence for inclusion within cyclic modulating agent
CINQKTC

SEQ ID NO: 1997 - protein, 6 aa, Artificial Sequence
  Cell adhesion recognition sequence for inclusion within cyclic modulating agent
CNQKTC

SEQ ID NO: 1998 - protein, 7 aa, Artificial Sequence
  Cell adhesion recognition sequence for inclusion within cyclic modulating agent
CINQKTC

SEQ ID NO: 1999 - protein, 5 aa, Artificial Sequence
  Cell adhesion recognition sequence for inclusion within cyclic modulating agent
  MOD_RES 5: Xaa = beta,beta-dimethyl cysteine
CNQKX

SEQ ID NO: 2000 - protein, 10 aa, Artificial Sequence
  Cell adhesion recognition sequence for inclusion within cyclic modulating agent
CFVINQKTGC

SEQ ID NO: 2001 - protein, 11 aa, Artificial Sequence
  Cell adhesion recognition sequence for inclusion within cyclic modulating agent
CIFVINQKTGC

SEQ ID NO: 2002 - protein, 10 aa, Artificial Sequence
  Cell adhesion recognition sequence for inclusion within cyclic modulating agent
  MOD_RES 2: beta,beta-tetramethylene cysteine
IXVINQKTCE

SEQ ID NO: 2003 - protein, 10 aa, Artificial Sequence
  Cell adhesion recognition sequence for inclusion within cyclic modulating agent
  MOD_RES 2: Xaa = beta,beta-pentamethylene cysteine
IXVINQKTGC

SEQ ID NO: 2004 - protein, 9 aa, Artificial Sequence
  Cell adhesion recognition sequence for inclusion within cyclic modulating agent
  MOD_RES 1: Xaa = beta-mercaptopropionic acid
XVINQKTGC

SEQ ID NO: 2005 - protein, 9 aa, Artificial Sequence
  Cell adhesion recognition sequence for inclusion within cyclic modulating agent
  MOD_RES 1: Xaa = beta,beta-pentamethylene-beta-mercaptopropionic acid
XVINQKTGC

SEQ ID NO: 2006 - protein, 5 aa, Artificial Sequence
  Desomglein Cell adhesion recognition sequence
  MOD_RES 4: Xaa = D-Serine
NQKXS

SEQ ID NO: 2007 - protein, 5 aa, Unknown
  Example sequence showing cyclization technique
WNQKW

SEQ ID NO: 2008 - protein, 6 aa, Unknown
  Classical cadherin cell adhesion sequence
SHAVSS

SEQ ID NO: 2009 - protein, 6 aa, Unknown
  Classical cadherin cell adhesion sequence
AHAVDI

What is claimed is:

1. A modulating agent comprising a linear peptide having the sequence N—Ac-IYAYATTADG-NH$_2$ (SEQ ID NO:285).

2. A modulating agent according to claim 1, wherein the agent contains no more than 50 consecutive amino acid residues present within a desmosomal cadherin.

3. A modulating agent according to claim 1, wherein the agent is a peptide having at most 50 amino acid residues.

4. A modulating agent according to claim 1, wherein the agent is a peptide having at most 16 amino acid residues.

5. A modulating agent according to any one of claims 1 or 2–4 linked to a detectable marker.

6. A modulating agent according to any one of claims 1 or 2–4 linked to a targeting agent.

7. A modulating agent according to any one of claims 1 or 2–4 linked to a support material.

8. A modulating agent according to claim 7, wherein the support material is a polymeric matrix.

9. A modulating agent according to claim 7, wherein the support material is selected from the group consisting of plastic dishes, plastic tubes, sutures, membranes ultra thin films, bioreactors and microparticles.

10. A modulating agent according to any one of claims 1 or 2–4, further comprising one or more of:
   (a) a CAR sequence that is selected from a group consisting of HAV, RGD, YIGSR (SEQ ID NO:1933), KYSFNYDGSE (SEQ ID NO:1934), IWKHKGRDVILKKDVRF (SEQ ID NO:1935), IYSY (SEQ ID NO:1936), LYHY (SEQ ID NO:1937), DDK, IDDK (SEQ ID NO:1938), DDKS (SEQ ID NO:1939), VIDDK (SEQ ID NO:1940), IDDKS (SEQ ID NO:1941), DAE, VDAE (SEQ ID NO:1980), DAET (SEQ ID NO:1981), RVDAE (SEQ ID NO:1982), VDAET (SEQ ID NO:1983), FFVIEEYTG (SEQ ID NO:367), IFVIDDKSG (SEQ ID NO:368), YFSVEAQTG (SEQ ID NO:369), VFRVDAETG (SEQ ID NO:370), FFLLEEYTG (SEQ ID NO:371), LFIINENTG (SEQ ID NO:372), YFSVESETG (SEQ ID NO: 373), IFNIDSGNG (SEQ ID NO:374), IFIIDENTG (SEQ ID NO:375), YFSVEPKTG (SEQ ID NO:376), YFNIDANSG (SEQ ID NO:377), MFVLEEFSG (SEQ ID NO:378); IFQINDVTG (SEQ ID NO:379), VFTIDETTG (SEQ ID NO:380), YFSIDPKTG (SEQ ID NO:381), IFIIDDTTG (SEQ ID NO:382), YFSVDPKTG (SEQ ID NO:383), FFNIDANTG (SEQ ID NO:384), VFSIDKFTG (SEQ ID NO:385), LFSIDELTG (SEQ ID NO:386), IFRINENTG (SEQ ID NO:387), FFVVEEYTG (SEQ ID NO:388), IFLIDELTG (SEQ ID NO:389), HFTVDPKTG (SEQ ID NO:390), IFDIDADTG (SEQ ID NO:391), YFQINNKTG (SEQ ID NO:392), LFALDLVTG (SEQ ID NO:393), YFTINRDNG (SEQ ID NO:394), LFSIDPKTG (SEQ ID NO:395), LFEIDPSSG (SEQ ID No:396), KFHIDPVSG (SEQ ID NO:403), QFSIDADTG (SEQ ID NO:404), TFHIDSVSG (SEQ ID NO:405), AFNIDSNSG (SEQ ID NO:406), KFTIDSSSG (SEQ ID NO:407), LFTLDEKNG (SEQ ID NO:408), and KFLINEKTG (SEQ ID NO:409); and/or
   (b) an antibody or antigen-binding fragment thereof that specifically binds to a CAR sequence that is selected from a group consisting of HAV, RGD, YIGSR (SEQ ID NO:1933), KYSFNYDGSE (SEQ ID NO:1934), IWKHKGRDVILKKDVRF (SEQ ID NO:1935), IYSY (SEQ ID NO:1936), LYHY (SEQ ID NO:1937), DDK, IDDK (SEQ ID NO:1938), DDKS (SEQ ID NO:1939), VIDDK (SEQ ID NO:1940), IDDKS (SEQ ID NO: 1941), DAE, VDAE (SEQ ID NO:1980), DAET (SEQ ID NO:1981), RVDAE (SEQ ID NO:1982), VDAET (SEQ ID NO:1983), FFVIEEYTG (SEQ ID NO:367), IFVIDDKSG (SEQ ID NO:368), YFSVEAQTG (SEQ ID NO:369), VFRVDAETG (SEQ ID NO:370), FFLLEEYTG (SEQ ID NO:371), LFIINENTG (SEQ ID NO:372), YFSVESETG (SEQ ID NO: 373), IFNIDSGNG (SEQ ID NO:374), IFIIDENTG (SEQ ID NO:375), YFSVEPKTG (SEQ ID NO:376), YFNIDANSG (SEQ ID NO:377), MFVLEEFSG (SEQ ID NO:378); IFQINDVTG (SEQ ID NO:379), VFTIDETTG (SEQ ID NO:380), YFSIDPKTG (SEQ ID NO:381), IFIIDDTTG (SEQ ID NO:382), YFSVDPKTG (SEQ ID NO:383), FFNIDANTG (SEQ ID NO:384), VFSIDKFTG (SEQ ID NO:385), LFSIDELTG (SEQ ID NO:386), IFRINENTG (SEQ ID NO:387), FFVVEEYTG (SEQ ID NO:388), IFLIDELTG (SEQ ID NO:389), HFTVDPKTG (SEQ ID NO:390), IFDIDADTG (SEQ ID NO:391), YFQINNKTG (SEQ ID NO:392), LFALDLVTG (SEQ ID NO:393), YFTINRDNG (SEQ ID NO:394), LFSID- 11. A composition comprising a modulating agent according to any one of claims 1 or 2–4, in combination with a physiologically acceptable carrier.

12. A composition according to claim 11, further comprising a drug.

13. A composition according to claim 11, wherein the modulating agent is present within a sustained-release formulation.

14. A composition according to claim 11, further comprising a modulator of cell adhesion that comprises one or more of:
   (a) a CAR sequence that is selected from a group consisting of HAV, RGD, YIGSR (SEQ ID NO:1933), KYSFNYDGSE (SEQ ID NO:1934), IWKHKGRDVILKKDVRF (SEQ ID NO:1935), IYSY (SEQ ID NO:1936), LYHY (SEQ ID NO:1937), DDK, IDDK (SEQ ID NO:1938), DDKS (SEQ ID NO:1939), VIDDK (SEQ ID NO:1940), IDDKS (SEQ ID NO: 1941), DAE, VDAE (SEQ ID NO:1980), DAET (SEQ ID NO:1981), RVDAE (SEQ ID NO:1982), VDAET (SEQ ID NO:1983), FFVIEEYTG (SEQ ID NO:367), IFVIDDKSG (SEQ ID NO:368), YFSVEAQTG (SEQ ID NO:369), VFRVDAETG (SEQ ID NO:370), FFLLEEYTG (SEQ ID NO:371), LFIINENTG (SEQ ID NO:372), YFSVESETG (SEQ ID NO: 373), IFNIDSGNG (SEQ ID NO:374), IFIIDENTG (SEQ ID NO:375), YFSVEPKTG (SEQ ID NO:376), YFNIDANSG (SEQ ID NO:377), MFVLEEFSG (SEQ ID NO:378); IFQINDVTG (SEQ ID NO:379), VFTIDETTG (SEQ ID NO:380), YFSIDPKTG (SEQ ID NO:381), IFIIDDTTG (SEQ ID NO:382), YFSVDPKTG (SEQ ID NO:383), FFNIDANTG (SEQ ID NO:384), VFSIDKFTG (SEQ ID NO:385), LFSIDELTG (SEQ ID NO:386), IFRINENTG (SEQ ID NO:387), FFVVEEYTG (SEQ ID NO:388), IFLIDELTG (SEQ ID NO:389), HFTVDPKTG (SEQ ID NO:390), IFDIDADTG (SEQ ID NO:391), YFQINNKTG (SEQ ID NO:392), LFALDLVTG (SEQ ID NO:393), YFTINRDNG (SEQ ID NO:394), LFSID- PKTG (SEQ ID NO:395), LFEIDPSSG (SEQ ID No:396), KFHIDPVSG (SEQ ID NO:403), QFSIDADTG (SEQ ID NO:404), TFHIDSVSG (SEQ ID NO:405), AFNIDSNSG (SEQ ID NO:406), KFTIDSSSG (SEQ ID NO:407), LFTLDEKNG (SEQ ID NO:408), and KFLINEKTG (SEQ ID NO:409); and/or (b) an antibody or antigen-binding fragment thereof that specifically binds to a CAR sequence that is selected from a group consisting of HAV, RGD, YIGSR (SEQ ID NO:1933), KYSFNYDGSE (SEQ ID NO:1934), IWKHKGRDVILKKDVRF (SEQ ID NO:1935), IYSY (SEQ ID NO:1936), LYHY (SEQ ID NO:1937), DDK, IDDK (SEQ ID NO:1938), DDKS (SEQ ID NO:1939), VIDDK (SEQ ID NO:1940), IDDKS (SEQ ID NO: 1941), DAE, VDAE (SEQ ID NO:1980), DAET (SEQ ID NO:1981), RVDAE (SEQ ID NO:1982), VDAET (SEQ ID NO:1983), FFVIEEYTG (SEQ ID NO:367), IFVIDDKSG (SEQ ID NO:368), YFSVEAQTG (SEQ ID NO:369), VFRVDAETG (SEQ ID NO:370), FFLLEEYTG (SEQ ID NO:371), LFIINENTG (SEQ ID NO:372), YFSVESETG (SEQ ID NO: 373), IFNIDSGNG (SEQ ID NO:374), IFIIDENTG (SEQ ID NO:375), YFSVEPKTG (SEQ ID NO:376), YFNIDANSG (SEQ ID NO:377), MFVLEEFSG (SEQ ID NO:378); IFQINDVTG (SEQ ID NO:379), VFTIDETTG (SEQ ID NO:380), YFSIDPKTG (SEQ ID NO:381), IFIIDDTTG (SEQ ID NO:382), YFSVDPKTG (SEQ ID NO:383), FFNIDANTG (SEQ ID NO:384), VFSIDKFTG (SEQ ID NO:385), LFSIDELTG (SEQ ID NO:386), IFRINENTG (SEQ ID NO:387), FFVVEEYTG (SEQ ID NO:388), IFLIDELTG (SEQ ID NO:389), HFTVDPKTG (SEQ ID NO:390), IFDIDADTG (SEQ ID NO:391), YFQINNKTG (SEQ ID NO:392), LFALDLVTG (SEQ ID NO:393), YFTINRDNG (SEQ ID NO:394), LFSIDPKTG (SEQ ID NO:395), LFEIDPSSG (SEQ ID No:396), KFHIDPVSG (SEQ ID NO:403), QFSIDADTG (SEQ ID NO:404), TFHIDSVSG (SEQ ID NO:405), AFNIDSNSG (SEQ ID NO:406), KFTIDSSSG (SEQ ID NO:407), LFTLDEKNG (SEQ ID NO:408), and KFLINEKTG (SEQ ID NO:409).

* * * * *